United States Patent 12,508,308 (INFLUENZA mRNA VACCINES) - sequence listing, part 4

SEQ ID NO: 14527 - protein, 470 aa, Artificial Sequence
  neuraminidase__InfluenzaA__ABB80048
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSVELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNGDTANWSWPDGAELPFTIDK

SEQ ID NO: 14528 - protein, 469 aa, Artificial Sequence
  neuraminidase__InfluenzaA__ABB80084
MNPNQKIITIGSVSLTIATICFLMQIAILVTTVTLHFKQYECNSPSNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISQLSGSAQHVEECSCYPRYPGVRCVCRDNWKGSNRPIVDINVKDHSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14529 - protein, 469 aa, Artificial Sequence; identical to SEQ ID NO: 14514
  neuraminidase__InfluenzaA__ABB80095

SEQ ID NO: 14530 - protein, 469 aa, Artificial Sequence; identical to SEQ ID NO: 14514
  neuraminidase__InfluenzaA__ABB80162

SEQ ID NO: 14531 - protein, 469 aa, Artificial Sequence; identical to SEQ ID NO: 14514
  neuraminidase__InfluenzaA__ABB80199

SEQ ID NO: 14532 - protein, 469 aa, Artificial Sequence
  neuraminidase__InfluenzaA__ABB80210
MNPNQKIITIGSVSLTIATICFLMQIAILVTTVTLHFKQYECSSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRGNRSGYSGIFSVEGKSCINRCFYVELIRGRKQETEVWWTSNSIVVFCGTSGTYGTGSWPDGADIGLMPI

SEQ ID NO: 14533 - protein, 469 aa, Artificial Sequence
  neuraminidase__InfluenzaA__ABB80232
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLAAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGDDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14534 - protein, 469 aa, Artificial Sequence
  neuraminidase__InfluenzaA__ABB80243
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISQLSGSAQHVEECSCYPRYPGVRCVCRDNWKGSNRPIVDINVKDHSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKKENEVWWTSNSIVVFCGTSGTYGTGSWPDGADINLMPI

SEQ ID NO: 14535 - protein, 469 aa, Artificial Sequence
  neuraminidase__InfluenzaA__ABB80254
MNPNQKIITIGSVSLTIATICFLMQIAILVTTVTLHFKQYECSSPPNNQVMLCEPTIIERNITEIVYLTNTTIEKEICPKLAEYRNWSKPQCKITGFAPFSKDNSIRLSAGGDIWVTREPYVSCGPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGICTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14536 - protein, 469 aa, Artificial Sequence; identical to SEQ ID NO: 14127
  neuraminidase__InfluenzaA__ABB80495

SEQ ID NO: 14537 - protein, 469 aa, Artificial Sequence; identical to SEQ ID NO: 14514
  neuraminidase__InfluenzaA__ABB80506

SEQ ID NO: 14538 - protein, 469 aa, Artificial Sequence; identical to SEQ ID NO: 14514
  neuraminidase__InfluenzaA__ABB80517

SEQ ID NO: 14539 - protein, 469 aa, Artificial Sequence; identical to SEQ ID NO: 14514
  neuraminidase__InfluenzaA__ABB80532

SEQ ID NO: 14540 - protein, 469 aa, Artificial Sequence
  neuraminidase__InfluenzaA__ABB80644
MNPNQKIITIGSVSLTIATICFLMQIAILVTTVTLHFKQYECSSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSNKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14541 - protein, 469 aa, Artificial Sequence
  neuraminidase__InfluenzaA__ABB80664
MNPNQKIITIGSVSLTIATICFLMQIAILVTTVTLHFKQYECSSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKVLFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14542 - protein, 469 aa, Artificial Sequence
  neuraminidase__InfluenzaA__ABB80675
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLAAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISQLSGSAQHVEECSCYPRYPGVRCVCRDNWKGSNRPIVDINVKDYSIVSSYVCSGLVGDTPRKNDSSSSSYCLNPNNEEGGHGVKGWAFDDGDDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14543 - protein, 469 aa, Artificial Sequence
  neuraminidase__InfluenzaA__ABB80685
MNPNQKIITIGSVSLTIATICFLMQIAILVITVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISQLSGSAQHVEECSCYPRYPGVRCVCRDNWKGSNRPIVDINVKDHSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14544 - protein, 469 aa, Artificial Sequence; identical to SEQ ID NO: 14514
  neuraminidase__InfluenzaA__ABB80696

SEQ ID NO: 14545 - protein, 469 aa, Artificial Sequence
  neuraminidase__InfluenzaA__ABB80707
MNPNQKIITIGSVSLTIATICFLMQIAILVTTVTLHFKQYECSSPPNNQVMLCEPTIIERNITEIVYLTNTTIEKEICPKLAEYRNWSKPQCKITGFAPFSKDNSIRLSAGGDIWVTREPYVSCGPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14546 - protein, 469 aa, Artificial Sequence; identical to SEQ ID NO: 14514
  neuraminidase__InfluenzaA__ABB80716

SEQ ID NO: 14547 - protein, 469 aa, Artificial Sequence
  neuraminidase__InfluenzaA__ABB80725
MNPNQKIITIGSVSLTIATICFLMQIAILVTTVTLHFKQYECSSPPNNQVMLCEPTVIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRGNRSGYSGIFSVEGKSCINRCFYVELIRGRKQETEVWWTSNSIVAFCGTSGTYGTGSWPDGADINLMPI

SEQ ID NO: 14548 - protein, 469 aa, Artificial Sequence
  neuraminidase__InfluenzaA__ABB80740
MNPNQKIITIGSVSLTIATICFLMQIAILVTTVTLHFKQYECCSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRGNRSGYSGIFSVEGKSCINRCFYVELIRGRKQETEVWWTSNSIVAFCGTSGTYGTGSWPDGADINLMPI

SEQ ID NO: 14549 - protein, 469 aa, Artificial Sequence; identical to SEQ ID NO: 14514
  neuraminidase__InfluenzaA__ABB80751

SEQ ID NO: 14550 - protein, 469 aa, Artificial Sequence; identical to SEQ ID NO: 14233
  neuraminidase__InfluenzaA__ABB82186

SEQ ID NO: 14551 - protein, 470 aa, Artificial Sequence; identical to SEQ ID NO: 14396
  neuraminidase__InfluenzaA__ABB82197

SEQ ID NO: 14552 - protein, 470 aa, Artificial Sequence; identical to SEQ ID NO: 14386
  neuraminidase__InfluenzaA__ABB82208

SEQ ID NO: 14553 - protein, 470 aa, Artificial Sequence
  neuraminidase__InfluenzaA__ABB82219
MNPNQKIITIGSISIAIGIISLMLQIGNIISIWASHSIQTGSQNHTGICNQRIITYENSTWVNHTYVNINNTNVIAEKDKTSVTLAGNSSLCSISGWAIYTKDNSIRIGSKGDVFVIREPFISCSNLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDAADWSWPDGAELPFTIDK

SEQ ID NO: 14554 - protein, 469 aa, Artificial Sequence
  neuraminidase__InfluenzaA__ABB82230
MNPNQKIITIGSVSLTIATVCFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPIVDINVKDYSIDSRYVCSGLVGDTPRNNDRSSNSNCRNPNNDKGNHGVKGWAFDDGNDVWMGRTISKDSRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 14555 - protein, 469 aa, Artificial Sequence
  neuraminidase__InfluenzaA__ABB83018
MNPNQKIITIGSVSLTIATICFLTQIAILVTTVTLHFKQYGCNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRNQETEVLWTSNSIVVFCGTSGTYGTGSWPDGADINLMPI

SEQ ID NO: 14556 - protein, 469 aa, Artificial Sequence; identical to SEQ ID NO: 14555
  neuraminidase__InfluenzaA__ABB83029

SEQ ID NO: 14557 - protein, 469 aa, Artificial Sequence; identical to SEQ ID NO: 14382
  neuraminidase__InfluenzaA__ABB83130

SEQ ID NO: 14558 - protein, 469 aa, Artificial Sequence
  neuraminidase__InfluenzaA__ABB83141
MNPNQKIITIGSVSLTIATICFLSQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRDNRSGYSGIFSVEGKSCINRCFYVELIRGRNQETEVLWTSNSIVVFCGTSGTYGTGSWPDGADINLMPI

SEQ ID NO: 14559 - protein, 469 aa, Artificial Sequence
  neuraminidase__InfluenzaA__ABB86876
MNTNQRIITIGTVCLIVGIISLLLQIGNIVSLWISHSIQTGGKNHSEMCNQNVITYVNNTWVNRTYVNISNTNIATVQDVTSVILAGNSSLCSVSGWAIYSKDNSIRIGSKGDIFVIREPFISCSHLECRTFFLTQGALLNDKHSNGTVKDRSPYRTLMSCPIGEAPSPYNSRFESVAWSASACHDGMGWLTIGISGPDNGAVAVLKYNGIITDTIKSWRNKILRTQESECVCMNGSCFTVLTDGPSNGQASYKIFKVEKGKIIKSIELDAPNYHYEECSCYPDTGKVMCVCRDNWHASNRPWVSFDQNLDYQIGYICSGVFGDNPRSNDGKGNCGPVLSNGANGVKGFSFRYGNGVWIGRTKSINSRSGFEMIWDPNGWTGTDSSFSMKQDIIALTDWSGYSGSFVQHPELTGMNCIRPCFWVELIRGQPKESTIWASGSSISFCGVDSETTSWSWPDGADLPFTIDK

SEQ ID NO: 14560 - protein, 469 aa, Artificial Sequence
  neuraminidase__InfluenzaA__ABB86886
MNTNQRIITIGTACLAIGIVSLLLQIGNIVSLWISHSIQTEEKNHSETCSQNFITHENNTWVNQTYINISNTNNVVGQGVTSIMLAGNSSLCPISGWAIYSKDNSIRIGSKGDIFVIREPFISCSHLECRTFFLTQGALLNDKHSNGTVKDRSPYRTLMSCPIGEAPSPYNSRFESVAWSASACHDGMGWLTIGISGPDNGAVAVFKYNGIITDTIKSWRNKILRTQESECVCINGSCFTIMTDGPSNGQASYKIFKMEKGKIIKSVELDAPNYHYEESSCYPDTGKVVCVCRDNWHASNRPWVSFDQNLDYQIGYICSGVFGDNPRSNDGKGNCGPVLSNGANGVKEVSFRYGNGVWIGRTKSISSRSGFEMIWDPNGWTETDSSFSIKQDIIALTDWSGYSGSFVQHPELTGMNCIKPCFWVELIRGQPKESTIWTSGSSISFCGVDSETASWSWPDGADLPFTIDK

SEQ ID NO: 14561 - protein, 469 aa, Artificial Sequence
  neuraminidase__InfluenzaA__ABB86898
MNPNQKIITIGSVSLTLATICFLMQIAILVTTVTLHFKQQECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNNTVHDRTPYRTLLMNELGVPFHLGTRQVCIAWSSSSCHDGKAWLHVCITGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGSRSGYSGIFSVEGKSCINRCFYVELIRGRKEETKVWWTSNSIVVFCGTSGTYGTGSWPDGADINLMPI

SEQ ID NO: 14562 - protein, 469 aa, Artificial Sequence
  neuraminidase__InfluenzaA__ABB86906
MNTNQRIITIGTVCLIVGIISLLLQIGNIVSLWISHSIQTGGKNHSEMCNQNVITYVNNTWVNRTYVNISNTNIATVQDVTSVILAGNSSLCSVSGWAIYSKDNSIRIGSKGDIFVIREPFISCSHLECRTFFLTQGALLNDKHSNGTVKDRSPYRTLMSCPIGEAPSPYNSRFESVAWSASACHDGMGWLTIGISGPDNGAVAVLKYNGIITDTIKSWRNKILRTQESECVCMNGSCFTVLTDGPSNGQASYEIFKVEKGKIIKSIELDAPNYHYEECSCYPDTGKVMCVCRDNWHASNRPWVSFDQNLNYQIGYICSGVFGDNPRSNDGKGNCGPVLSNGANGVKGFSFRYGNGVWIGRTKSISSRSGFEMVWDPNGWTGTDSRFSMKQDIIALTDWSGYSGSFVQHPELTGMNCIRPCFWVELIRGQPKESTIWASGSSISFCGVNSETASWSWPDGADLPFTIDK

SEQ ID NO: 14563 - protein, 469 aa, Artificial Sequence
  neuraminidase__InfluenzaA__ABB86916
MNPNQKIITIGSVSLTIATICFLTQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCITGDDKNATASFIYNGRLVDSISSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRDNRSGYSGIFSVEGKSCINRCFYVELIRGRNQETEVLWTSNSIVVFCGTSGTYGTGSWPDGADINLMPI

SEQ ID NO: 14564 - protein, 469 aa, Artificial Sequence
  neuraminidase__InfluenzaA__ABB86928
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCITGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLNPNNEEGGHGVKGWAFDDGNDVWMGRTISEKLRSGYETFKVIEGWSKPNSKLQINRQVIVERGNRSGYSGIFSIEGKSCINRCFYVELIRGRKEETKVWWTSNSIVVFCGTSGTYGTGSWPDGADINLMPI

SEQ ID NO: 14565 - protein, 469 aa, Artificial Sequence
  neuraminidase__InfluenzaA__ABB86936
MNTNQRIITIGTVCLIVGIISLLLQIGNIVSLWINHSIQTEGKNHSEMCNQNVITYVNNTWVNRTYVNISNTNIATVQDVTSVILAGNSSLCPVSGWAIYSKDNSIRIGSKGDIFVIREPFISCSHLECRTFFLTQGALLNDKHSNGTVRDRSPYRTLMSCPTGEAPSPYNSRFESVAWSASACHDGMGWLTIGISGPDNGAVAVLKYNGIITDTIKSWRNKILRTQESECVCMNGSCFTVLTDGPSNGQASYKIFKVEKGKIIKSIELDAPNYHYEECSCYPDTGKVMCVCRDNWHASNRPWIYFDQNLDYQIGYICSGVFGDNPRSNDGKGNCGPVLSNGANGVKGFSFRYGNGVWIGRTKSINSRSGFEMIWDPNGWTGTDSSFSMKQDILATTDWSGYSGSFVQHPELTGMNCIRPCFWVELIRGQPKESTIWASGSSISFCGVNSETANWSWPDGADLPFTIDK

SEQ ID NO: 14566 - protein, 469 aa, Artificial Sequence
  neuraminidase__InfluenzaA__ABB86947
MNTNQRIITIGTVCLIVGIISLLSQIGNIVSLWIIHSIQTGGKNHSEMCNQNVITYVNNTWVNRTYINISNTNIATVKDVTSVILAGNSSLCPVSGWAIYSKDNSIRIGSKGDIFVIREPFISCSHLECRTFFLTQGALLNDKHSNGTVKDRSPYRTLMSCPIGEAPSPYNSRFESVAWSASACHDGMGWLTIGISGPDNGAVAVLKYNGIITDTIKSWRNKILRTQESECVCMNGSCFTVLTDGPSNGQASYKIFKVEKGKIIKSIELDAPNYHYEECSCYPDAGKVMCVCRDNWHASNRPWVSFDQNLDYQMGYICSGVFGDNPRSNDGKGNCGPVLSNGANGVKGFSFRYGNGVWIGRTKSINSRSGFEMIWDPNGWTGTDSSFSMKQDIIALTDWSGYSGSFVQHPELTGMNCIRPCFWVELIRGQPKESTIWASGSSISFCGVNSETASWSWPDGADLPFTIDK

SEQ ID NO: 14567 - protein, 469 aa, Artificial Sequence
  neuraminidase__InfluenzaA__ABB86957
MNTNQRIITVGTVCLIVGIVSLLLQIGNIVSLWISHSIQTGEKNHSEVCNQNIITYENKTWVNQTYVNISNTNIAEGQGVTSIIMAGNSSLCPVSGWAIYSKDNSIRIGSKGDIFVIREPFISCSHLECRTFFLTQGALLNDRHSNGTVKDRSPYRTLMSCPIGEAPSPYNSRFESVAWSASACHDGMGWLTIGISGSDNEAVAVLKYNGIITDTIKSWRNKILRTQESECVCINGSCFTIMTDGPSNGQASYKIFKMEKGKIIKSVELEAPNYHYEECSCYPDTGKVVCVCRDNWHASNRPWVSFNQNLDYQIGYICSGVFGDNPRSNDGKGNCGPVPSNGANGVKGFSFRYGNGVWIGRTKSIFSRSGFEMIWDPNGWTETDSSFSIKQDIIALTDWSGYSGSFVQHPELTGMNCIRPCFWVELIRGQPKESTIWTSGSSISFCGVDSETASWSWPDGADLPFTIDK

SEQ ID NO: 14568 - protein, 469 aa, Artificial Sequence
  neuraminidase__InfluenzaA__ABB96333
MNPNQKIITIGSVSLTIATICFLMQIAILVTTVTLHFKQYDCDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPVVDINVKDYSIASSYVCSGLVGDTPRKNDRYSSSYCRNPNNEKGNHGVKGWAFDDGNDVWMGRTISDESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14569 - protein, 469 aa, Artificial Sequence
  neuraminidase__InfluenzaA__ABB96344
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGRCYQFALGQGTTLDNKHSNDTIHDRTPHRTLLMNELGVPFHLGTRQVCIAWSSSSCHDGKAWLHVCVTGYDKNATASFIYDGRLVDSIGSWSKNILRTQESECVCINGTCTVVMTDGSASERADTKVLFIEEGKIVHISPLSGSAQHVEECSCYPRYPGVRCVCRDNWKGSNRPVVDINVKDYSIASSYVCSGLVGDTPRKNDRYSSSYCRNPNNEKGNHGVKGWAFDDGNDVWMGRTISDESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14570 - protein, 469 aa, Artificial Sequence
  neuraminidase__InfluenzaA__ABB96398
MNPNQKIITIGSVSLTIATICFLMQIAILVTTVTLHFKQYECDSPANNQVMPCEPIIIERNITEIVYLTNTTIEKETCPKLVEYRNWSKPQCKITGFAPFSKDNSIRLSAGGDIWVTREPYVSCDPGKCYQFALGQGTTLDNKHSNDTIHDRTPYRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPVVDINVKDYSIASSYVCSGLVGDTPRKNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14571 - protein, 469 aa, Artificial Sequence; identical to SEQ ID NO: 14382
  neuraminidase__InfluenzaA__ABB96490

SEQ ID NO: 14572 - protein, 469 aa, Artificial Sequence
  neuraminidase__InfluenzaA__ABB96501
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPSKCYQFALGQGTTLDNKHSNDTIHDRTPHRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKSQINRQVIVDSGNRSGYSGIFSVEGKSCINRCFYVELIRGREQETRVWWTSNSIVVFCGTSGTYGTGSWPDGADINLMPI

SEQ ID NO: 14573 - protein, 469 aa, Artificial Sequence
  neuraminidase__InfluenzaA__ABB96534
MNPNQKIITIGSVSLTIATICFLMQIAILVTTVTLHFKQYECSSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14574 - protein, 469 aa, Artificial Sequence
  neuraminidase__InfluenzaA__ABC02237
MNPNQKIITIGSVSLTIATICFLMQIAILVTTVTLHFKQYECSSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISQLSGSAQHVEECSCYPRYPGVRCVCRDNWKGSNRPIVDINIKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRGNRSGYSGIFSVEGKSCINRCFYVELIRGRKQETEVWWTSNSIVAFCGTSGTYGTGSWPDGADINLMPI

SEQ ID NO: 14575 - protein, 469 aa, Artificial Sequence
  neuraminidase__InfluenzaA__ABC02258
MNPNQKIITIGSVSLTIATICFLMQIAILVTTVTLHFKQYECDSPANNQIMPCEPTIIERNITEIVYLTNITIEKEICPKLVEYRNWSKPQCKITGFAPFSKDNSIRLSAGGDIWVTREPYVSCDPSKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRKNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGAGSWPDGADINLMPI

SEQ ID NO: 14576 - protein, 469 aa, Artificial Sequence
  neuraminidase__InfluenzaA__ABC02269
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHTSPLSGSAQHVEECSCYPRYPGVRCICRDNWKGSNRPVVDINVKDYSIDSSYVCSGLVGDTPRNNDRSSSSYCRNPNNEKGTHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14577 - protein, 470 aa, Artificial Sequence
  neuraminidase__InfluenzaA__ABC02280
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGSLLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14578 - protein, 469 aa, Artificial Sequence; identical to SEQ ID NO: 14573
  neuraminidase__InfluenzaA__ABC02302

SEQ ID NO: 14579 - protein, 469 aa, Artificial Sequence; identical to SEQ ID NO: 14570
  neuraminidase__InfluenzaA__ABC02313

SEQ ID NO: 14580 - protein, 469 aa, Artificial Sequence; identical to SEQ ID NO: 14575
  neuraminidase__InfluenzaA__ABC02324

SEQ ID NO: 14581 - protein, 469 aa, Artificial Sequence
  neuraminidase__InfluenzaA__ABC02335
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIKEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14582 - protein, 469 aa, Artificial Sequence
  neuraminidase__InfluenzaA__ABC39808
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPSKCYQFALGQGTTLDNKHSNDTIHDRTPHRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPVVDINVKDYSIVSSYVCSGLVGDTPRKNDRSSSSYCRNPNNEKGDHGVKGWAFDDGNDVWMGRTISEESRSGYETFKVIGGWSTPNSKSQINRQVIVDSGNRSGYSGIFSVEGKSCINRCFYVELIRGRKQETRVWWTSNSIVVFCGTSGTYGTGSWPDGADINLMPI

SEQ ID NO: 14583 - protein, 469 aa, Artificial Sequence; identical to SEQ ID NO: 14382
  neuraminidase__InfluenzaA__ABC40525

SEQ ID NO: 14584 - protein, 470 aa, Artificial Sequence
  neuraminidase__InfluenzaA__ABC40536
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVIKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14585 - protein, 469 aa, Artificial Sequence; identical to SEQ ID NO: 14576
  neuraminidase__InfluenzaA__ABC40547

SEQ ID NO: 14586 - protein, 469 aa, Artificial Sequence
  neuraminidase__InfluenzaA__ABC40558
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPYRTLLMNELGVPFHLGTRQVCIAWSSSSCHDGKAWLHVCVTGHDKNATASFIYDGRLVDSIGSWSKSILRTQESECVCINGTCTVVMTDGSASERADTKILFIEEGKIVHISPLSGSAQHVEECSCYPRYPGVRCVCRDNWKGSNRPVVDINVKDYSIVSSYVCSGLVGDTPRKNDRSSSSYCQNPNNEKGNHGVKGWAFDDGNDVWMGRTISEESRSGYETFKVIGGWSTPNSKLQINRQVIVDIDNRSGYSGIFSVEGKSCINRCFYVELIRGREQETRVWWTSNSIVVFCGTSGTYGTGSWPDGADINLMPI

SEQ ID NO: 14587 - protein, 469 aa, Artificial Sequence
  neuraminidase__InfluenzaA__ABC40611
MNPNQKIITIGSISLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 14588 - protein, 469 aa, Artificial Sequence
  neuraminidase__InfluenzaA__ABC40622
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGNASGRADTKILFIEEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14589 - protein, 469 aa, Artificial Sequence
  neuraminidase__InfluenzaA__ABC40634
MNPNQKIITIGSVSLTIATICFLTQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCIDGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRNQETEVLWTSNSIVVFCGTSGTYGTGSWPDGADINLMPI

SEQ ID NO: 14590 - protein, 469 aa, Artificial Sequence
  neuraminidase__InfluenzaA__ABC40645
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSVVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14591 - protein, 469 aa, Artificial Sequence
  neuraminidase__InfluenzaA__ABC41706
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14592 - protein, 470 aa, Artificial Sequence
  neuraminidase__InfluenzaA__ABC41717
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAVTDWSGYSGSFVQHPELTGLDCIRPCFWVELVRGLPRENTTIWTSGSSISFCGVDSDTANWSWPDGAELPFTIDK

SEQ ID NO: 14593 - protein, 469 aa, Artificial Sequence
  neuraminidase__InfluenzaA__ABC41728
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKNILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14594 - protein, 469 aa, Artificial Sequence; identical to SEQ ID NO: 14591
  neuraminidase__InfluenzaA__ABC41742

SEQ ID NO: 14595 - protein, 469 aa, Artificial Sequence; identical to SEQ ID NO: 14591
  neuraminidase__InfluenzaA__ABC41956

SEQ ID NO: 14596 - protein, 469 aa, Artificial Sequence; identical to SEQ ID NO: 14591
  neuraminidase__InfluenzaA__ABC41967

SEQ ID NO: 14597 - protein, 469 aa, Artificial Sequence; identical to SEQ ID NO: 14591
  neuraminidase__InfluenzaA__ABC42017

SEQ ID NO: 14598 - protein, 469 aa, Artificial Sequence; identical to SEQ ID NO: 14591
  neuraminidase__InfluenzaA__ABC42117

SEQ ID NO: 14599 - protein, 469 aa, Artificial Sequence; identical to SEQ ID NO: 14591
  neuraminidase__InfluenzaA__ABC42128

SEQ ID NO: 14600 - protein, 469 aa, Artificial Sequence; identical to SEQ ID NO: 14591
  neuraminidase__InfluenzaA__ABC42139

SEQ ID NO: 14601 - protein, 469 aa, Artificial Sequence
  neuraminidase__InfluenzaA__ABC42150
MNPNQKIITIGSVSLTIATICFLMQIAILATTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISGKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14602 - protein, 469 aa, Artificial Sequence; identical to SEQ ID NO: 14591
  neuraminidase__InfluenzaA__ABC42161

SEQ ID NO: 14603 - protein, 469 aa, Artificial Sequence
  neuraminidase__InfluenzaA__ABC42172
MNPNQKIITIGSVSLTIATICSLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14604 - protein, 469 aa, Artificial Sequence; identical to SEQ ID NO: 14591
  neuraminidase__InfluenzaA__ABC42183

SEQ ID NO: 14605 - protein, 469 aa, Artificial Sequence; identical to SEQ ID NO: 14591
  neuraminidase__InfluenzaA__ABC42195

SEQ ID NO: 14606 - protein, 469 aa, Artificial Sequence; identical to SEQ ID NO: 14591
  neuraminidase__InfluenzaA__ABC42310

SEQ ID NO: 14607 - protein, 469 aa, Artificial Sequence; identical to SEQ ID NO: 14591
  neuraminidase__InfluenzaA__ABC42321

SEQ ID NO: 14608 - protein, 469 aa, Artificial Sequence; identical to SEQ ID NO: 14591
  neuraminidase__InfluenzaA__ABC42349

SEQ ID NO: 14609 - protein, 469 aa, Artificial Sequence; identical to SEQ ID NO: 14591
  neuraminidase__InfluenzaA__ABC42464

SEQ ID NO: 14610 - protein, 469 aa, Artificial Sequence; identical to SEQ ID NO: 14591
  neuraminidase__InfluenzaA__ABC42497

SEQ ID NO: 14611 - protein, 469 aa, Artificial Sequence; identical to SEQ ID NO: 14591
  neuraminidase__InfluenzaA__ABC42508

SEQ ID NO: 14612 - protein, 469 aa, Artificial Sequence; identical to SEQ ID NO: 14591
  neuraminidase__InfluenzaA__ABC42519

SEQ ID NO: 14613 - protein, 469 aa, Artificial Sequence; identical to SEQ ID NO: 14591
  neuraminidase__InfluenzaA__ABC42530

SEQ ID NO: 14614 - protein, 469 aa, Artificial Sequence; identical to SEQ ID NO: 14591
  neuraminidase__InfluenzaA__ABC42577

SEQ ID NO: 14615 - protein, 469 aa, Artificial Sequence; identical to SEQ ID NO: 14591
  neuraminidase__InfluenzaA__ABC42588

SEQ ID NO: 14616 - protein, 469 aa, Artificial Sequence; identical to SEQ ID NO: 14327
  neuraminidase__InfluenzaA__ABC42599

SEQ ID NO: 14617 - protein, 469 aa, Artificial Sequence; identical to SEQ ID NO: 14327
  neuraminidase__InfluenzaA__ABC42610

SEQ ID NO: 14618 - protein, 469 aa, Artificial Sequence; identical to SEQ ID NO: 14327
  neuraminidase__InfluenzaA__ABC42621

SEQ ID NO: 14619 - protein, 469 aa, Artificial Sequence; identical to SEQ ID NO: 14327
  neuraminidase__InfluenzaA__ABC42632

SEQ ID NO: 14620 - protein, 469 aa, Artificial Sequence; identical to SEQ ID NO: 14327
  neuraminidase__InfluenzaA__ABC42643

SEQ ID NO: 14621 - protein, 469 aa, Artificial Sequence; identical to SEQ ID NO: 14327
  neuraminidase__InfluenzaA__ABC42654

SEQ ID NO: 14622 - protein, 469 aa, Artificial Sequence; identical to SEQ ID NO: 14327
  neuraminidase__InfluenzaA__ABC42665

SEQ ID NO: 14623 - protein, 469 aa, Artificial Sequence; identical to SEQ ID NO: 14327
  neuraminidase__InfluenzaA__ABC42676

SEQ ID NO: 14624 - protein, 469 aa, Artificial Sequence; identical to SEQ ID NO: 14327
  neuraminidase__InfluenzaA__ABC42687

SEQ ID NO: 14625 - protein, 469 aa, Artificial Sequence; identical to SEQ ID NO: 14327
  neuraminidase__InfluenzaA__ABC42698

SEQ ID NO: 14626 - protein, 469 aa, Artificial Sequence; identical to SEQ ID NO: 14327
  neuraminidase__InfluenzaA__ABC42709

SEQ ID NO: 14627 - protein, 469 aa, Artificial Sequence; identical to SEQ ID NO: 14327
  neuraminidase__InfluenzaA__ABC42720

SEQ ID NO: 14628 - protein, 469 aa, Artificial Sequence
  neuraminidase__InfluenzaA__ABC42742
MNPNQKIITIGSVSLTISTICFFMQIAILMTTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRRNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14629 - protein, 469 aa, Artificial Sequence; identical to SEQ ID NO: 14327
  neuraminidase__InfluenzaA__ABC42764

SEQ ID NO: 14630 - protein, 469 aa, Artificial Sequence; identical to SEQ ID NO: 14327
  neuraminidase__InfluenzaA__ABC42775

SEQ ID NO: 14631 - protein, 469 aa, Artificial Sequence; identical to SEQ ID NO: 14327
  neuraminidase__InfluenzaA__ABC42786

SEQ ID NO: 14632 - protein, 469 aa, Artificial Sequence; identical to SEQ ID NO: 14327
  neuraminidase__InfluenzaA__ABC42797

SEQ ID NO: 14633 - protein, 469 aa, Artificial Sequence; identical to SEQ ID NO: 14327
  neuraminidase__InfluenzaA__ABC42808

SEQ ID NO: 14634 - protein, 469 aa, Artificial Sequence; identical to SEQ ID NO: 14327
  neuraminidase__InfluenzaA__ABC42819

SEQ ID NO: 14635 - protein, 469 aa, Artificial Sequence
  neuraminidase__InfluenzaA__ABC42841
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASRKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14636 - protein, 469 aa, Artificial Sequence; identical to SEQ ID NO: 14327
  neuraminidase__InfluenzaA__ABC42852

SEQ ID NO: 14637 - protein, 469 aa, Artificial Sequence; identical to SEQ ID NO: 14327
  neuraminidase__InfluenzaA__ABC42863

SEQ ID NO: 14638 - protein, 469 aa, Artificial Sequence; identical to SEQ ID NO: 14166
  neuraminidase__InfluenzaA__ABC42874

SEQ ID NO: 14639 - protein, 469 aa, Artificial Sequence; identical to SEQ ID NO: 14166
  neuraminidase__InfluenzaA__ABC42885

SEQ ID NO: 14640 - protein, 469 aa, Artificial Sequence; identical to SEQ ID NO: 14166
  neuraminidase__InfluenzaA__ABC42896

SEQ ID NO: 14641 - protein, 469 aa, Artificial Sequence; identical to SEQ ID NO: 14591
  neuraminidase__InfluenzaA__ABC42914

SEQ ID NO: 14642 - protein, 469 aa, Artificial Sequence; identical to SEQ ID NO: 14591
  neuraminidase__InfluenzaA__ABC42932

SEQ ID NO: 14643 - protein, 469 aa, Artificial Sequence
  neuraminidase__InfluenzaA__ABC42943
MNPNQKIITIGSVSLTIATICFLMQIAILVTTVTLHFKQHECNSPPNNQVMLCEPTIIERNITEIVYLTNTTIEKEICPKLVGYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14644 - protein, 469 aa, Artificial Sequence; identical to SEQ ID NO: 14591
  neuraminidase__InfluenzaA__ABC42954

SEQ ID NO: 14645 - protein, 469 aa, Artificial Sequence; identical to SEQ ID NO: 14591
  neuraminidase__InfluenzaA__ABC42965

SEQ ID NO: 14646 - protein, 469 aa, Artificial Sequence
  neuraminidase__InfluenzaA__ABC42976
MNPNQKIITIGSVSLTIATICFLMQIAILVTTVTLHFKQHECNSPPNNQAMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14647 - protein, 469 aa, Artificial Sequence; identical to SEQ ID NO: 14591
  neuraminidase__InfluenzaA__ABC42987

SEQ ID NO: 14648 - protein, 469 aa, Artificial Sequence; identical to SEQ ID NO: 14591
  neuraminidase__InfluenzaA__ABC42998

SEQ ID NO: 14649 - protein, 469 aa, Artificial Sequence; identical to SEQ ID NO: 14591
  neuraminidase__InfluenzaA__ABC43009

SEQ ID NO: 14650 - protein, 469 aa, Artificial Sequence; identical to SEQ ID NO: 14591
  neuraminidase__InfluenzaA__ABC43020

SEQ ID NO: 14651 - protein, 469 aa, Artificial Sequence
  neuraminidase__InfluenzaA__ABC43042
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMSI

SEQ ID NO: 14652 - protein, 469 aa, Artificial Sequence; identical to SEQ ID NO: 14591
  neuraminidase__InfluenzaA__ABC43053

SEQ ID NO: 14653 - protein, 469 aa, Artificial Sequence
  neuraminidase__InfluenzaA__ABC43064
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEKTEVWWTSNSIVVFCGTSGTYGTGSWPDGADINLMPI

SEQ ID NO: 14654 - protein, 469 aa, Artificial Sequence; identical to SEQ ID NO: 14591
  neuraminidase__InfluenzaA__ABC43075

SEQ ID NO: 14655 - protein, 469 aa, Artificial Sequence
  neuraminidase__InfluenzaA__ABC43086
MNPNQKIITIGSVSLIIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14656 - protein, 469 aa, Artificial Sequence; identical to SEQ ID NO: 14591
  neuraminidase__InfluenzaA__ABC43097

SEQ ID NO: 14657 - protein, 469 aa, Artificial Sequence; identical to SEQ ID NO: 14591
  neuraminidase__InfluenzaA__ABC43108

SEQ ID NO: 14658 - protein, 469 aa, Artificial Sequence; identical to SEQ ID NO: 14591
  neuraminidase__InfluenzaA__ABC43119

SEQ ID NO: 14659 - protein, 469 aa, Artificial Sequence; identical to SEQ ID NO: 14327
  neuraminidase__InfluenzaA__ABC43130

SEQ ID NO: 14660 - protein, 469 aa, Artificial Sequence; identical to SEQ ID NO: 14327
  neuraminidase__InfluenzaA__ABC43141

SEQ ID NO: 14661 - protein, 469 aa, Artificial Sequence; identical to SEQ ID NO: 14327
  neuraminidase__InfluenzaA__ABC43152

SEQ ID NO: 14662 - protein, 469 aa, Artificial Sequence; identical to SEQ ID NO: 14327
  neuraminidase__InfluenzaA__ABC43163

SEQ ID NO: 14663 - protein, 469 aa, Artificial Sequence; identical to SEQ ID NO: 14327
  neuraminidase__InfluenzaA__ABC43174

SEQ ID NO: 14664 - protein, 469 aa, Artificial Sequence
  neuraminidase__InfluenzaA__ABC43185
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTRILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14665 - protein, 469 aa, Artificial Sequence; identical to SEQ ID NO: 14327
  neuraminidase__InfluenzaA__ABC43478

SEQ ID NO: 14666 - protein, 469 aa, Artificial Sequence; identical to SEQ ID NO: 14327
  neuraminidase__InfluenzaA__ABC43489

SEQ ID NO: 14667 - protein, 469 aa, Artificial Sequence; identical to SEQ ID NO: 14327
  neuraminidase__InfluenzaA__ABC43500

SEQ ID NO: 14668 - protein, 469 aa, Artificial Sequence
  neuraminidase__InfluenzaA__ABC43511
MNPNQKIITIGSVSLTISTICFFMQIAILITTVTLHFKQYEFNSPPNNQVMLCETTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14669 - protein, 469 aa, Artificial Sequence; identical to SEQ ID NO: 14327
  neuraminidase__InfluenzaA__ABC43522

SEQ ID NO: 14670 - protein, 469 aa, Artificial Sequence; identical to SEQ ID NO: 14327
  neuraminidase__InfluenzaA__ABC43533

SEQ ID NO: 14671 - protein, 469 aa, Artificial Sequence; identical to SEQ ID NO: 14327
  neuraminidase__InfluenzaA__ABC43544

SEQ ID NO: 14672 - protein, 469 aa, Artificial Sequence; identical to SEQ ID NO: 14327
  neuraminidase__InfluenzaA__ABC43555

SEQ ID NO: 14673 - protein, 469 aa, Artificial Sequence; identical to SEQ ID NO: 14570
  neuraminidase__InfluenzaA__ABC46557

SEQ ID NO: 14674 - protein, 469 aa, Artificial Sequence
  neuraminidase__InfluenzaA__ABC46579
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPYRTLLMNELGVPFHLGTRQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14675 - protein, 469 aa, Artificial Sequence; identical to SEQ ID NO: 14514
  neuraminidase__InfluenzaA__ABC50170

SEQ ID NO: 14676 - protein, 469 aa, Artificial Sequence; identical to SEQ ID NO: 14514
  neuraminidase__InfluenzaA__ABC50181

SEQ ID NO: 14677 - protein, 469 aa, Artificial Sequence; identical to SEQ ID NO: 14514
  neuraminidase__InfluenzaA__ABC50192

SEQ ID NO: 14678 - protein, 469 aa, Artificial Sequence; identical to SEQ ID NO: 14166
  neuraminidase__InfluenzaA__ABC50203

SEQ ID NO: 14679 - protein, 469 aa, Artificial Sequence
  neuraminidase__InfluenzaA__ABC50214
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIIDINVKDYSIVSSYVCSGLVGDTPRKNDSFSSSHCLDPNNEEGGHGVKGWAFDDGNDVWMGRTISEKLRSGYETFKVIEGWSKPNPKLQTNRQVIVERGNRSGYSGIFSVEGKSCINRCFYVELIRGRKEETEVWWTSNSIVVFCGTSGTYGTGSWPDGADINLMPI

SEQ ID NO: 14680 - protein, 469 aa, Artificial Sequence; identical to SEQ ID NO: 14166
  neuraminidase__InfluenzaA__ABC50225

SEQ ID NO: 14681 - protein, 469 aa, Artificial Sequence; identical to SEQ ID NO: 14166
  neuraminidase__InfluenzaA__ABC50247

SEQ ID NO: 14682 - protein, 469 aa, Artificial Sequence
  neuraminidase__InfluenzaA__ABC50258
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIIDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSIEGKSCINRCFYVELIRGRKEETEVWWTSNSIVVFCGTSGTYGTGSWPDGADINLMPI

SEQ ID NO: 14683 - protein, 469 aa, Artificial Sequence; identical to SEQ ID NO: 14166
  neuraminidase__InfluenzaA__ABC50280

SEQ ID NO: 14684 - protein, 469 aa, Artificial Sequence; identical to SEQ ID NO: 14166
  neuraminidase__InfluenzaA__ABC50291

SEQ ID NO: 14685 - protein, 469 aa, Artificial Sequence
  neuraminidase__InfluenzaA__ABC50302
MNPNQKIITIGSVSLTIATICFLMQIAILITTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14686 - protein, 469 aa, Artificial Sequence
  neuraminidase__InfluenzaA__ABC50313
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14687 - protein, 469 aa, Artificial Sequence; identical to SEQ ID NO: 14166
  neuraminidase__InfluenzaA__ABC50324

SEQ ID NO: 14688 - protein, 469 aa, Artificial Sequence; identical to SEQ ID NO: 14154
  neuraminidase__InfluenzaA__ABC50335

SEQ ID NO: 14689 - protein, 469 aa, Artificial Sequence
  neuraminidase__InfluenzaA__ABC50346
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIIDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14690 - protein, 469 aa, Artificial Sequence; identical to SEQ ID NO: 14166
  neuraminidase__InfluenzaA__ABC50357

SEQ ID NO: 14691 - protein, 469 aa, Artificial Sequence; identical to SEQ ID NO: 14166
  neuraminidase__InfluenzaA__ABC50368

SEQ ID NO: 14692 - protein, 469 aa, Artificial Sequence; identical to SEQ ID NO: 14166
  neuraminidase__InfluenzaA__ABC50379

SEQ ID NO: 14693 - protein, 469 aa, Artificial Sequence; identical to SEQ ID NO: 14166
  neuraminidase__InfluenzaA__ABC50390

SEQ ID NO: 14694 - protein, 469 aa, Artificial Sequence
  neuraminidase__InfluenzaA__ABC50412
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14695 - protein, 469 aa, Artificial Sequence; identical to SEQ ID NO: 14694
  neuraminidase__InfluenzaA__ABC50423

SEQ ID NO: 14696 - protein, 469 aa, Artificial Sequence; identical to SEQ ID NO: 14279
  neuraminidase__InfluenzaA__ABC54671

SEQ ID NO: 14697 - protein, 469 aa, Artificial Sequence; identical to SEQ ID NO: 14411
  neuraminidase__InfluenzaA__ABC54682

SEQ ID NO: 14698 - protein, 469 aa, Artificial Sequence; identical to SEQ ID NO: 14591
  neuraminidase__InfluenzaA__ABC67322

SEQ ID NO: 14699 - protein, 469 aa, Artificial Sequence; identical to SEQ ID NO: 14166
  neuraminidase__InfluenzaA__ABC67474

SEQ ID NO: 14700 - protein, 469 aa, Artificial Sequence; identical to SEQ ID NO: 14689
  neuraminidase__InfluenzaA__ABC67546

SEQ ID NO: 14701 - protein, 469 aa, Artificial Sequence
  neuraminidase__InfluenzaA__ABC67557
MNPNQKIITIGSVSLTISTICFFMQIAILVTTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14702 - protein, 469 aa, Artificial Sequence
  neuraminidase__InfluenzaA__ABC67568
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGANINLMPI

SEQ ID NO: 14703 - protein, 469 aa, Artificial Sequence
  neuraminidase__InfluenzaA__ABC67579
MNPNQKIITIGSVSLTIATICFLMQIAILVTTVTLHFKQYECNSPPNNQVMLCEPTIIERNITEIVYLTNTTIEKEICPKPAEYRNWSKPQCKITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISQLSGSAQHVEECSCYPRYPGVRCVCRDNWKGSNRPIVDINVKDHSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14704 - protein, 469 aa, Artificial Sequence; identical to SEQ ID NO: 14327
  neuraminidase__InfluenzaA__ABC67590

SEQ ID NO: 14705 - protein, 469 aa, Artificial Sequence; identical to SEQ ID NO: 14327
  neuraminidase__InfluenzaA__ABC67601

SEQ ID NO: 14706 - protein, 469 aa, Artificial Sequence; identical to SEQ ID NO: 14166
  neuraminidase__InfluenzaA__ABC67612

SEQ ID NO: 14707 - protein, 469 aa, Artificial Sequence; identical to SEQ ID NO: 14166
  neuraminidase__InfluenzaA__ABC67623

SEQ ID NO: 14708 - protein, 469 aa, Artificial Sequence
  neuraminidase__InfluenzaA__ABC67634
MNPNQKIITIGSVSLTIATICFLMQIAILVTTVTLHFKQYECNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14709 - protein, 469 aa, Artificial Sequence; identical to SEQ ID NO: 14166
  neuraminidase__InfluenzaA__ABC67645

SEQ ID NO: 14710 - protein, 469 aa, Artificial Sequence; identical to SEQ ID NO: 14166
  neuraminidase__InfluenzaA__ABC67656

SEQ ID NO: 14711 - protein, 469 aa, Artificial Sequence
  neuraminidase__InfluenzaA__ABC67700
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNSNSKLQINRQVIVDRGNRSGYSGIFSVEGKSCINRCFYVELIRGRKEETEVLWTSNSIVVFCGTSGTYGTGSWPDGADINLMPI

SEQ ID NO: 14712 - protein, 469 aa, Artificial Sequence
  neuraminidase__InfluenzaA__ABC67711
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14713 - protein, 469 aa, Artificial Sequence
  neuraminidase__InfluenzaA__ABC67736
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCVAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14714 - protein, 469 aa, Artificial Sequence
  neuraminidase__InfluenzaA__ABC67809
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14715 - protein, 469 aa, Artificial Sequence; identical to SEQ ID NO: 14591
  neuraminidase__InfluenzaA__ABC67820

SEQ ID NO: 14716 - protein, 469 aa, Artificial Sequence; identical to SEQ ID NO: 14570
  neuraminidase__InfluenzaA__ABC67842

SEQ ID NO: 14717 - protein, 469 aa, Artificial Sequence; identical to SEQ ID NO: 14166
  neuraminidase__InfluenzaA__ABC67853

SEQ ID NO: 14718 - protein, 469 aa, Artificial Sequence; identical to SEQ ID NO: 14570
  neuraminidase__InfluenzaA__ABC67864

SEQ ID NO: 14719 - protein, 469 aa, Artificial Sequence; identical to SEQ ID NO: 14689
  neuraminidase__InfluenzaA__ABC67886

SEQ ID NO: 14720 - protein, 469 aa, Artificial Sequence; identical to SEQ ID NO: 14166
  neuraminidase__InfluenzaA__ABC67897

SEQ ID NO: 14721 - protein, 469 aa, Artificial Sequence; identical to SEQ ID NO: 14166
  neuraminidase__InfluenzaA__ABC67970

SEQ ID NO: 14722 - protein, 469 aa, Artificial Sequence
  neuraminidase__InfluenzaA__ABC67981
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPQYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14723 - protein, 469 aa, Artificial Sequence
  neuraminidase__InfluenzaA__ABC67992
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNNSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEEIEVWWTSNSIVVFCGTSGTYGTGSWPDGADINLMPI

SEQ ID NO: 14724 - protein, 469 aa, Artificial Sequence; identical to SEQ ID NO: 14689
  neuraminidase__InfluenzaA__ABC68003

SEQ ID NO: 14725 - protein, 469 aa, Artificial Sequence
  neuraminidase__InfluenzaA__ABC68052
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMIDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14726 - protein, 469 aa, Artificial Sequence; identical to SEQ ID NO: 14166
  neuraminidase__InfluenzaA__ABC68063

SEQ ID NO: 14727 - protein, 469 aa, Artificial Sequence; identical to SEQ ID NO: 14166
  neuraminidase__InfluenzaA__ABC68074

SEQ ID NO: 14728 - protein, 469 aa, Artificial Sequence; identical to SEQ ID NO: 14712
  neuraminidase__InfluenzaA__ABC68085

SEQ ID NO: 14729 - protein, 469 aa, Artificial Sequence
  neuraminidase__InfluenzaA__ABC68096
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLHINRQVIVERGNRSGYSGIFSVEGKSCINRCFYVELIRGRKEETEVWWTSNSIVVFCGTSGTYGTGSWPDGADINLMPI

SEQ ID NO: 14730 - protein, 469 aa, Artificial Sequence
  neuraminidase__InfluenzaA__ABC68225
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQETEVLWTSNSIVVFCGTSGTYGTGSWPDGADINLMPI

SEQ ID NO: 14731 - protein, 469 aa, Artificial Sequence; identical to SEQ ID NO: 14519
  neuraminidase__InfluenzaA__ABC68236

SEQ ID NO: 14732 - protein, 449 aa, Artificial Sequence
  neuraminidase__InfluenzaA__ABC72646
MNPNKKIITIGSICMVTGMVSLMLQIGNLISIWVSHSIHTGNQQKAEPISNTNFLTEKAVASVKLAGNSSLCPINGWAVYSKDNSIRIGSKGDVFVIREPFISCSHLECRTFFLTQGSLLNDKHSNGTVKDRSPHRTLMSCPVGEAPSPYNSRFESVAWSASACHDGTSWLTIGISGPDSGAVAVLKYNGIITDTIKSWRNNILRTQESECACVNGSCFTVMTDGPSNGQASHKIFKMDKGKVVKSVELDAPNYHYEECSCYPDAGEITCVCRDNWHGSNRPWVSFNQNLEYQIGYICSGVFGDTPRPNDGTGSCGPVSSNGTYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 14733 - protein, 469 aa, Artificial Sequence; identical to SEQ ID NO: 14095
  neuraminidase__InfluenzaA__ABC84392

SEQ ID NO: 14734 - protein, 469 aa, Artificial Sequence; identical to SEQ ID NO: 14509
  neuraminidase__InfluenzaA__ABC84403

SEQ ID NO: 14735 - protein, 469 aa, Artificial Sequence; identical to SEQ ID NO: 14514
  neuraminidase__InfluenzaA__ABC84414

SEQ ID NO: 14736 - protein, 469 aa, Artificial Sequence
  neuraminidase__InfluenzaA__ABC84425
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKNCINRCFYVELIRGRKEETEVLWTSNSIVVFCGTSGTYGTGSWPDGADINLMPI

SEQ ID NO: 14737 - protein, 469 aa, Artificial Sequence; identical to SEQ ID NO: 14327
  neuraminidase__InfluenzaA__ABC84436

SEQ ID NO: 14738 - protein, 469 aa, Artificial Sequence
  neuraminidase__InfluenzaA__ABC84447
MNPNQKIITIGSVSLTIATICFLMQIAILVTTVTLHFKQYECNSPPNNQVMLCEPTIIERNITEIVHLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14739 - protein, 469 aa, Artificial Sequence; identical to SEQ ID NO: 14714
  neuraminidase__InfluenzaA__ABC84501

SEQ ID NO: 14740 - protein, 469 aa, Artificial Sequence; identical to SEQ ID NO: 14714
  neuraminidase__InfluenzaA__ABC84512

SEQ ID NO: 14741 - protein, 469 aa, Artificial Sequence
  neuraminidase__InfluenzaA__ABC84523
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLADSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14742 - protein, 469 aa, Artificial Sequence
  neuraminidase__InfluenzaA__ABC84545
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGSADTKILFIEEGKIVHISPLSGSAQHVEECSCYPRYPGVRCICRDNWKGSNRPVVDINVKDHSIDSSYVCSGLVGDTPRNNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14743 - protein, 469 aa, Artificial Sequence; identical to SEQ ID NO: 14730
  neuraminidase__InfluenzaA__ABC84574

SEQ ID NO: 14744 - protein, 469 aa, Artificial Sequence; identical to SEQ ID NO: 14730
  neuraminidase__InfluenzaA__ABC85757

SEQ ID NO: 14745 - protein, 469 aa, Artificial Sequence; identical to SEQ ID NO: 14741
  neuraminidase__InfluenzaA__ABC85768

SEQ ID NO: 14746 - protein, 469 aa, Artificial Sequence; identical to SEQ ID NO: 14730
  neuraminidase__InfluenzaA__ABC85779

SEQ ID NO: 14747 - protein, 469 aa, Artificial Sequence; identical to SEQ ID NO: 14730
  neuraminidase__InfluenzaA__ABC85790

SEQ ID NO: 14748 - protein, 469 aa, Artificial Sequence; identical to SEQ ID NO: 14714
  neuraminidase__InfluenzaA__ABC85801

SEQ ID NO: 14749 - protein, 469 aa, Artificial Sequence; identical to SEQ ID NO: 14714
  neuraminidase__InfluenzaA__ABC85812

SEQ ID NO: 14750 - protein, 469 aa, Artificial Sequence; identical to SEQ ID NO: 14741
  neuraminidase__InfluenzaA__ABC85823

SEQ ID NO: 14751 - protein, 469 aa, Artificial Sequence; identical to SEQ ID NO: 14713
  neuraminidase__InfluenzaA__ABC85834

SEQ ID NO: 14752 - protein, 469 aa, Artificial Sequence; identical to SEQ ID NO: 14714
  neuraminidase__InfluenzaA__ABC85845

SEQ ID NO: 14753 - protein, 469 aa, Artificial Sequence; identical to SEQ ID NO: 14741
  neuraminidase__InfluenzaA__ABC85856

SEQ ID NO: 14754 - protein, 469 aa, Artificial Sequence; identical to SEQ ID NO: 14713
  neuraminidase__InfluenzaA__ABC85867

SEQ ID NO: 14755 - protein, 469 aa, Artificial Sequence; identical to SEQ ID NO: 14712
  neuraminidase__InfluenzaA__ABC85900

SEQ ID NO: 14756 - protein, 469 aa, Artificial Sequence
  neuraminidase__InfluenzaA__ABC85911
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDMWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14757 - protein, 469 aa, Artificial Sequence
  neuraminidase__InfluenzaA__ABC85922
MNPNQKIITIGSVSLTIATICFLMQIAILVTTVTLHFKQYECNSPPNNQVMLCEPTTIERNITEIVYLTNTTIEKEICPKLAEYRNWSKPQCNITGFAPFSKDNSIRLSAGGDIWVTREPYVSCDSDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14758 - protein, 469 aa, Artificial Sequence; identical to SEQ ID NO: 14166
  neuraminidase__InfluenzaA__ABC85933

SEQ ID NO: 14759 - protein, 469 aa, Artificial Sequence
  neuraminidase__InfluenzaA__ABC85955
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINRMPI

SEQ ID NO: 14760 - protein, 469 aa, Artificial Sequence; identical to SEQ ID NO: 14166
  neuraminidase__InfluenzaA__ABC85966

SEQ ID NO: 14761 - protein, 469 aa, Artificial Sequence; identical to SEQ ID NO: 14166
  neuraminidase__InfluenzaA__ABC85977

SEQ ID NO: 14762 - protein, 469 aa, Artificial Sequence
  neuraminidase__InfluenzaA__ABC85988
MNPNQKIITIGSVSLTIATICFLMQIAILVTTVTLHFKQYECNSPPNNQVMLCEPTIIERNITEIVYLTNTTIEKGICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 14763 - protein, 469 aa, Artificial Sequence; identical to SEQ ID NO: 14327
  neuraminidase__InfluenzaA__ABC85999

SEQ ID NO: 14764 - protein, 469 aa, Artificial Sequence; identical to SEQ ID NO: 14327
  neuraminidase__InfluenzaA__ABC86010

SEQ ID NO: 14765 - protein, 469 aa, Artificial Sequence
  neuraminidase__InfluenzaA__ABC86021
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGANINLMPI

SEQ ID NO: 14766 - protein, 469 aa, Artificial Sequence; identical to SEQ ID NO: 14591
  neuraminidase__InfluenzaA__ABC86127

SEQ ID NO: 14767 - protein, 469 aa, Artificial Sequence; identical to SEQ ID NO: 14674
  neuraminidase__InfluenzaA__ABC86140

SEQ ID NO: 14768 - protein, 469 aa, Artificial Sequence; identical to SEQ ID NO: 14484
  neuraminidase__InfluenzaA__ABC86151

SEQ ID NO: 14769 - protein, 470 aa, Artificial Sequence
  neuraminidase__InfluenzaA__ABC86240
MNPNQKIITIGSISVAIGIISLILQIGNIISIWASHSIQTGSQNYTGICNQKIITYENRTWVNQTYVNINNTNVVAGKDKTSMTLAGNSSLCPIRGWAIYTKDNSIRIGSKGDVFVIREPFISCSHLECRTFFLTQGALLNDKHSNGTIKDRSPFRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 14770 - protein, 469 aa, Artificial Sequence
  neuraminidase__InfluenzaA__ABC97377
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGSADTKILFIEEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 14771 - protein, 469 aa, Artificial Sequence; identical to SEQ ID NO: 14137
  neuraminidase__InfluenzaA__ABD15452

SEQ ID NO: 14772 - protein, 469 aa, Artificial Sequence; identical to SEQ ID NO: 14225
  neuraminidase__InfluenzaA__ABD15463

SEQ ID NO: 14773 - protein, 469 aa, Artificial Sequence; identical to SEQ ID NO: 14145
  neuraminidase__InfluenzaA__ABD15474

SEQ ID NO: 14774 - protein, 469 aa, Artificial Sequence
  neuraminidase__InfluenzaA__ABD15485
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGANINLMPI

SEQ ID NO: 14775 - protein, 469 aa, Artificial Sequence; identical to SEQ ID NO: 14225
  neuraminidase__InfluenzaA__ABD15496

SEQ ID NO: 14776 - protein, 469 aa, Artificial Sequence; identical to SEQ ID NO: 14145
  neuraminidase__InfluenzaA__ABD15507

SEQ ID NO: 14777 - protein, 470 aa, Artificial Sequence
  neuraminidase__InfluenzaA__ABD15518
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGGASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 14778 - protein, 469 aa, Artificial Sequence; identical to SEQ ID NO: 14327
  neuraminidase__InfluenzaA__ABD15529

SEQ ID NO: 14779 - protein, 469 aa, Artificial Sequence; identical to SEQ ID NO: 14514
  neuraminidase__InfluenzaA__ABD15551

SEQ ID NO: 14780 - protein, 469 aa, Artificial Sequence
  neuraminidase__InfluenzaA__ABD15562
MNPNQKIITIGSVSLTIATICFLMQIAILVTTVTLHFKQYECSSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTIVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14781 - protein, 469 aa, Artificial Sequence
  neuraminidase__InfluenzaA__ABD15573
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNGHSNDTVHDRTPYRTLLMNELGVPFHLGTKQVCMAWSSSSCHDGKAWLHVCVTGHDENATASFIYDGRLVDSIGSWSKKILRTQESECVCINGTCTVVMTDGSASGRADTKILFIEEGKIVHISQLSGSAQHVEECSCYPRYPGVRCVCRDNWKGSNRPIVDINVKDHSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14782 - protein, 469 aa, Artificial Sequence
  neuraminidase__InfluenzaA__ABD15584
MNPNQKIITIGSVSLTIATICFLMQIAILVTTVTLHFKQYECSSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDENDVWMGRTISEKFRSGYETFKVIEGWSKPNSKLQINRQVIVDRGNRSGYSGIFSVEGKSCINRCFYVELIRGRKQETEVWWTSNSIIVFCGTSGTYGTGSWPDGADINLMPI

SEQ ID NO: 14783 - protein, 469 aa, Artificial Sequence; identical to SEQ ID NO: 14514
  neuraminidase__InfluenzaA__ABD15595

SEQ ID NO: 14784 - protein, 469 aa, Artificial Sequence; identical to SEQ ID NO: 14514
  neuraminidase__InfluenzaA__ABD15606

SEQ ID NO: 14785 - protein, 469 aa, Artificial Sequence; identical to SEQ ID NO: 14514
  neuraminidase__InfluenzaA__ABD15617

SEQ ID NO: 14786 - protein, 469 aa, Artificial Sequence; identical to SEQ ID NO: 14573
  neuraminidase__InfluenzaA__ABD15639

SEQ ID NO: 14787 - protein, 469 aa, Artificial Sequence; identical to SEQ ID NO: 14730
  neuraminidase__InfluenzaA__ABD15650

SEQ ID NO: 14788 - protein, 469 aa, Artificial Sequence; identical to SEQ ID NO: 14253
  neuraminidase__InfluenzaA__ABD15661

SEQ ID NO: 14789 - protein, 469 aa, Artificial Sequence; identical to SEQ ID NO: 14730
  neuraminidase__InfluenzaA__ABD15683

SEQ ID NO: 14790 - protein, 469 aa, Artificial Sequence; identical to SEQ ID NO: 14253
  neuraminidase__InfluenzaA__ABD15694

SEQ ID NO: 14791 - protein, 469 aa, Artificial Sequence; identical to SEQ ID NO: 14730
  neuraminidase__InfluenzaA__ABD15705

SEQ ID NO: 14792 - protein, 469 aa, Artificial Sequence; identical to SEQ ID NO: 14730
  neuraminidase__InfluenzaA__ABD15727

SEQ ID NO: 14793 - protein, 469 aa, Artificial Sequence
  neuraminidase__InfluenzaA__ABD15749
MNPNQKIITIGSVSLTIATICFLMQIAVLVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14794 - protein, 469 aa, Artificial Sequence; identical to SEQ ID NO: 14793
  neuraminidase__InfluenzaA__ABD15760

SEQ ID NO: 14795 - protein, 469 aa, Artificial Sequence; identical to SEQ ID NO: 14730
  neuraminidase__InfluenzaA__ABD15771

SEQ ID NO: 14796 - protein, 469 aa, Artificial Sequence; identical to SEQ ID NO: 14730
  neuraminidase__InfluenzaA__ABD15782

SEQ ID NO: 14797 - protein, 469 aa, Artificial Sequence; identical to SEQ ID NO: 14730
  neuraminidase__InfluenzaA__ABD15793

SEQ ID NO: 14798 - protein, 469 aa, Artificial Sequence; identical to SEQ ID NO: 14714
  neuraminidase__InfluenzaA__ABD16306

SEQ ID NO: 14799 - protein, 469 aa, Artificial Sequence
  neuraminidase__InfluenzaA__ABD16317
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14800 - protein, 469 aa, Artificial Sequence; identical to SEQ ID NO: 14714
  neuraminidase__InfluenzaA__ABD16328

SEQ ID NO: 14801 - protein, 469 aa, Artificial Sequence
  neuraminidase__InfluenzaA__ABD16339
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14802 - protein, 469 aa, Artificial Sequence
  neuraminidase__InfluenzaA__ABD16361
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGKLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14803 - protein, 469 aa, Artificial Sequence; identical to SEQ ID NO: 14714
  neuraminidase__InfluenzaA__ABD16475

SEQ ID NO: 14804 - protein, 469 aa, Artificial Sequence; identical to SEQ ID NO: 14714
  neuraminidase__InfluenzaA__ABD16486

SEQ ID NO: 14805 - protein, 469 aa, Artificial Sequence; identical to SEQ ID NO: 14741
  neuraminidase__InfluenzaA__ABD16497

SEQ ID NO: 14806 - protein, 469 aa, Artificial Sequence; identical to SEQ ID NO: 14714
  neuraminidase__InfluenzaA__ABD16508

SEQ ID NO: 14807 - protein, 469 aa, Artificial Sequence
  neuraminidase__InfluenzaA__ABD16519
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKDILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14808 - protein, 469 aa, Artificial Sequence
  neuraminidase__InfluenzaA__ABD16530
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKRCINRCFYVELIRGRKEETEVWWTSNSIVVFCGTSGTYGTGSWPDGADINLMPI

SEQ ID NO: 14809 - protein, 469 aa, Artificial Sequence; identical to SEQ ID NO: 14591
  neuraminidase__InfluenzaA__ABD16541

SEQ ID NO: 14810 - protein, 469 aa, Artificial Sequence; identical to SEQ ID NO: 14714
  neuraminidase__InfluenzaA__ABD16552

SEQ ID NO: 14811 - protein, 469 aa, Artificial Sequence; identical to SEQ ID NO: 14713
  neuraminidase__InfluenzaA__ABD16563

SEQ ID NO: 14812 - protein, 469 aa, Artificial Sequence
  neuraminidase__InfluenzaA__ABD16574
MNPNQKIITIGSVSLTIATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRKKETRVWWTSNSIVVFCGTSGTYGTGSWPDGADINLMPI

SEQ ID NO: 14813 - protein, 469 aa, Artificial Sequence
  neuraminidase__InfluenzaA__ABD16585
MNPNQKIITIGSVSLTIATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGREQETRVWWTSNSIVVFCGTSGTYGTGSWPDGADINLMPI

SEQ ID NO: 14814 - protein, 469 aa, Artificial Sequence
  neuraminidase__InfluenzaA__ABD16721
MNPNQKIITIGSVSLTIATICFLMQIAILVTTVTLHFKQYECSSPPNNQVMPCEPIIIERNITKIVYLTNTTIEKEICPKLVEYRNWSKPQCKITGFAPFSKDNSIRLSAGGDIWVTREPYVSCDPGKCYQFALGQGTTLNNKHSNDTIHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCQNPNNEKGNHGVKGWAFDDGNDVWMGRTIGEELRSGYETFKVIGGWSTPNSKLQINRQVIVDSKNRSGYSGIFSVEGKSCINRCFYVELIRGREQETRVWWTSNSIVVFCGTSGTYGTGSWPDGADINLMPI

SEQ ID NO: 14815 - protein, 469 aa, Artificial Sequence; identical to SEQ ID NO: 14484
  neuraminidase__InfluenzaA__ABD16732

SEQ ID NO: 14816 - protein, 469 aa, Artificial Sequence
  neuraminidase__InfluenzaA__ABD16743
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHTSPLSGSAQHVEECSCYPRYPGVRCICRDNWKGSNRPVVDINVKDYSIDSSYVCSGLVGDTPRNNDRSSSSYCRNPNNEKGTHGVKGWAFDDGNDVWMGRTISEDSRSGYETFKVIGGWSTPNSKLQMNRQVIVDSDNRSGYSGIFSVEGKSCINRCFYVELIRGREQETRVWWTSNSIVVFCGTSGTYGTGSWPDGADINLMPI

SEQ ID NO: 14817 - protein, 469 aa, Artificial Sequence; identical to SEQ ID NO: 14576
  neuraminidase__InfluenzaA__ABD16754

SEQ ID NO: 14818 - protein, 469 aa, Artificial Sequence; identical to SEQ ID NO: 14674
  neuraminidase__InfluenzaA__ABD16765

SEQ ID NO: 14819 - protein, 469 aa, Artificial Sequence; identical to SEQ ID NO: 14118
  neuraminidase__InfluenzaA__ABD17326

SEQ ID NO: 14820 - protein, 469 aa, Artificial Sequence
  neuraminidase__InfluenzaA__ABD38137
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIIDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEEPEVWWTSNSIVVFCGTPGTYGTGSWPDGADINLMPI

SEQ ID NO: 14821 - protein, 470 aa, Artificial Sequence; identical to SEQ ID NO: 14386
  neuraminidase__InfluenzaA__ABD60782

SEQ ID NO: 14822 - protein, 469 aa, Artificial Sequence
  neuraminidase__InfluenzaA__ABD60793
MNPNQKIITIGSVSLTIATICFLMQIAILVTTVTLHFKQYECDSPVNNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIVSWSQNILRTQESECVCINGTCTVVMTDGSASERADTKILFIEEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDLWMGRTISEDSRSGYETFKVIGGWSTPNSKLQINRQVIVDSDNRSGYSGIFSVEGKSCINRCFYVELIRGREQETRVWWTSNSIIVFCGTSGTYGTGSWPDGADINLMPI

SEQ ID NO: 14823 - protein, 469 aa, Artificial Sequence; identical to SEQ ID NO: 14519
  neuraminidase__InfluenzaA__ABD60804

SEQ ID NO: 14824 - protein, 469 aa, Artificial Sequence; identical to SEQ ID NO: 14712
  neuraminidase__InfluenzaA__ABD60815

SEQ ID NO: 14825 - protein, 469 aa, Artificial Sequence; identical to SEQ ID NO: 14714
  neuraminidase__InfluenzaA__ABD60826

SEQ ID NO: 14826 - protein, 469 aa, Artificial Sequence; identical to SEQ ID NO: 14793
  neuraminidase__InfluenzaA__ABD60837

SEQ ID NO: 14827 - protein, 469 aa, Artificial Sequence
  neuraminidase__InfluenzaA__ABD60848
MNPNQKIITIGSVSLTIATICFLMQVAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14828 - protein, 470 aa, Artificial Sequence
  neuraminidase__InfluenzaA__ABD60881
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 14829 - protein, 470 aa, Artificial Sequence
  neuraminidase__InfluenzaA__ABD60892
MNPNQKIITIGSISIAIGIISLMLQIGNIISIWASHSIQTGSQNHTGICNQRVITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 14830 - protein, 470 aa, Artificial Sequence; identical to SEQ ID NO: 14828
  neuraminidase__InfluenzaA__ABD60903

SEQ ID NO: 14831 - protein, 470 aa, Artificial Sequence; identical to SEQ ID NO: 14415
  neuraminidase__InfluenzaA__ABD60914

SEQ ID NO: 14832 - protein, 469 aa, Artificial Sequence
  neuraminidase__InfluenzaA__ABD60925
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINIKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 14833 - protein, 470 aa, Artificial Sequence
  neuraminidase__InfluenzaA__ABD60947
MNPNQKIITIGSICMAIGIISLILQIGNIISIWVSHSIQTGSQNHTGICNQRIITYENSTWVNQTYVNISNTNVVAGKDTTSMTLAGNSSLCPIRGWAIYSKDNSIRIGSKGDVFVIREPFISCSHLECRTFFLTQGALLNDKHSNGTIKDRSPYRALMSCPIGEAPSPYNSRFESVAWSASACHDGMGWLTIGISGPDDGAVAVLKYNGIITETIKSWRKQILRTQESECVCVNGSCFTIMTDGPSDGPASYRIFKIEKGKITKSIELDAPNSHYEECSCYPDTGTVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 14834 - protein, 469 aa, Artificial Sequence
  neuraminidase__InfluenzaA__ABD61263
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGMKGWAFDDGNDVWMGRTISEKLRSGYETFKVIEGWSKPNSKLQVNRQVIVERGNRSGYSGIFSVEGKSCINRCFYVELIRGRKEETEVWWTSNSIVVFCGTSGTYGTGSWPDGADINLMPI

SEQ ID NO: 14835 - protein, 469 aa, Artificial Sequence; identical to SEQ ID NO: 14145
  neuraminidase__InfluenzaA__ABD61274

SEQ ID NO: 14836 - protein, 469 aa, Artificial Sequence
  neuraminidase__InfluenzaA__ABD61285
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGNASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 14837 - protein, 469 aa, Artificial Sequence; identical to SEQ ID NO: 14591
  neuraminidase__InfluenzaA__ABD61296

SEQ ID NO: 14838 - protein, 469 aa, Artificial Sequence; identical to SEQ ID NO: 14712
  neuraminidase__InfluenzaA__ABD61307

SEQ ID NO: 14839 - protein, 469 aa, Artificial Sequence; identical to SEQ ID NO: 14730
  neuraminidase__InfluenzaA__ABD61318

SEQ ID NO: 14840 - protein, 469 aa, Artificial Sequence; identical to SEQ ID NO: 14061
  neuraminidase__InfluenzaA__ABD61340

SEQ ID NO: 14841 - protein, 469 aa, Artificial Sequence; identical to SEQ ID NO: 14061
  neuraminidase__InfluenzaA__ABD61351

SEQ ID NO: 14842 - protein, 469 aa, Artificial Sequence
  neuraminidase__InfluenzaA__ABD61362
MNPNQKIITIGSVSLTIATICFLMQIAILVTTVTLHFKQYECNSPPNNQVMLCEPTIIERNITEIVYLTNTTIEKEVCPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADIDLMPI

SEQ ID NO: 14843 - protein, 469 aa, Artificial Sequence; identical to SEQ ID NO: 14793
  neuraminidase__InfluenzaA__ABD61373

SEQ ID NO: 14844 - protein, 469 aa, Artificial Sequence
  neuraminidase__InfluenzaA__ABD61384
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQETEVLWTSNSIVVFCGTSGTYGTGSWPDGADINLMPI

SEQ ID NO: 14845 - protein, 469 aa, Artificial Sequence; identical to SEQ ID NO: 14730
  neuraminidase__InfluenzaA__ABD61395

SEQ ID NO: 14846 - protein, 469 aa, Artificial Sequence; identical to SEQ ID NO: 14827
  neuraminidase__InfluenzaA__ABD61406

SEQ ID NO: 14847 - protein, 470 aa, Artificial Sequence; identical to SEQ ID NO: 14828
  neuraminidase__InfluenzaA__ABD61521

SEQ ID NO: 14848 - protein, 469 aa, Artificial Sequence
  neuraminidase__InfluenzaA__ABD61532
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLNNKHSNDTIHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGNHGVKGWAFDDGNDVWMGRTIGEELRSGYETFKVIGGWSTPNSKLQINRQVIVDSENRSGYSGIFSVEGKSCINRCFYVELIRGREQETRVWWTSNSIVVFCGTSGTYGTGSWPDGADISLMPI

SEQ ID NO: 14849 - protein, 470 aa, Artificial Sequence
  neuraminidase__InfluenzaA__ABD61543
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGNFVQHPELTGLDCIRPCFWVELVRGLPRENTTIWTSGSSISFCGVNSDTANWSWPDGAELPFTIDK

SEQ ID NO: 14850 - protein, 470 aa, Artificial Sequence; identical to SEQ ID NO: 14828
  neuraminidase__InfluenzaA__ABD63066

SEQ ID NO: 14851 - protein, 469 aa, Artificial Sequence; identical to SEQ ID NO: 14253
  neuraminidase__InfluenzaA__ABD77601

SEQ ID NO: 14852 - protein, 469 aa, Artificial Sequence
  neuraminidase__InfluenzaA__ABD77612
MNPNQKIITIGSVSLTIATICFLMQIAILVTTVTLHFKQYECNSPPNNQVMLCEPTIIERNITEIVYLTNTTIEKEMCPKLAEYRNWLKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASIIYNGRLVDSIGSWSKKILRTQESECVCINGTCTVVMTDGSASGKADTKILFIKEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKANSKLQINRQVIVDRGNRSGYSGIFSVESKSCINRCFYVELIRGRKQETEVLWTSNSIVVFCGTSGTYGTGSWPDGADINLMPI

SEQ ID NO: 14853 - protein, 469 aa, Artificial Sequence
  neuraminidase__InfluenzaA__ABD77634
MNPNQKIITIGSVSLTIATICFLMQIAILVTTVTLHFKQYECNSPPNNQVMLCEPTIIERNITEIVYLTNTTIEKEMCPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASIIYNGRLVDSIGSWSKKILRTQESECVCINGTCTVVMTDGSASGKADTKILFIKEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKANSKLQINRQVIVDRGNRSGYSGIFSVESKSCINRCFYVELIRGRKQETEVLWTSNSIVVFCGTSGTYGTGSWPDGADINLMPI

SEQ ID NO: 14854 - protein, 469 aa, Artificial Sequence; identical to SEQ ID NO: 14853
  neuraminidase__InfluenzaA__ABD77645

SEQ ID NO: 14855 - protein, 469 aa, Artificial Sequence; identical to SEQ ID NO: 14853
  neuraminidase__InfluenzaA__ABD77656

SEQ ID NO: 14856 - protein, 469 aa, Artificial Sequence; identical to SEQ ID NO: 14126
  neuraminidase__InfluenzaA__ABD77700

SEQ ID NO: 14857 - protein, 470 aa, Artificial Sequence; identical to SEQ ID NO: 14828
  neuraminidase__InfluenzaA__ABD77722

SEQ ID NO: 14858 - protein, 470 aa, Artificial Sequence; identical to SEQ ID NO: 14828
  neuraminidase__InfluenzaA__ABD77733

SEQ ID NO: 14859 - protein, 469 aa, Artificial Sequence
  neuraminidase__InfluenzaA__ABD77744
MNPNQKIITIGSVSLTIATICFLMQIVILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14860 - protein, 469 aa, Artificial Sequence; identical to SEQ ID NO: 14853
  neuraminidase__InfluenzaA__ABD77755

SEQ ID NO: 14861 - protein, 469 aa, Artificial Sequence; identical to SEQ ID NO: 14853
  neuraminidase__InfluenzaA__ABD77766

SEQ ID NO: 14862 - protein, 469 aa, Artificial Sequence
  neuraminidase__InfluenzaA__ABD77777
MNPNQKIITIGSVSLTIATICFLMQIVILVTTVTLHFKQYECNSPPNNQVMPCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 14863 - protein, 469 aa, Artificial Sequence; identical to SEQ ID NO: 14862
  neuraminidase__InfluenzaA__ABD77788

SEQ ID NO: 14864 - protein, 453 aa, Artificial Sequence
  neuraminidase__InfluenzaA__ABD77799
MNPNQKIITIGSICMVVGIISLILQIGNIISIWISHSIQTGNQNHTGICNQGIITYNVVAGQDSTSVILTGNSSLCPIRGWAIHSKDNGIRIGSKGDVFVIREPFISCSHLECRTFFLTQGALLNDKHSNGTVKDRSPYRALMSCPVGEAPSPYNSRFESVAWSASACHDGMGWLTIGISGPDNGAVAVLKYNGIITETIKSWRKKILRTQESECTCVNGSCFTIMTDGPSNGLASYKIFKIEKGKVTKSIELNAPNSHYEECSCYPDTGKVMCVCRDNWHGSNRPWVSFDQNLDYQIGYICSGVFGDNPRPKDGTGSCGPVSADGANGVKGFSYRYGNGVWIGRTKSDSSRHGFEMIWDPNGWTETDSRFSVRQDVVAMTDRSGYSGSFVQHPELTGLDCMRPCFWVELIRGRPEEETIWTSGSIISFCGVNSDTVDWSWPDGAELPFTIDK

SEQ ID NO: 14865 - protein, 469 aa, Artificial Sequence
  neuraminidase__InfluenzaA__ABD77810
MNPNQKIITIGSICMVVGIISLILQIGNIVSIWISHSIQTGNQNHTGTCNQSIITYKNSTWVNQTYVNISNTNVVAGKDTTSVILAGNSSLCPIRGWAIYSKDNGVRIGSKGDVFVIREPFISCSHLECRTFFLTQGALLNDKHSNGTVKDRSPYRALMSCPVGEAPSPYNSRFESVAWSASACHDGMGWLTIGISGPDDGAVAVLKYNGIITETIKSWRKEILRTQESECVCVNGSCFTIMTDGPSGGPASYKIFKIEKGKVTKSIELDAPNSHYEECSCYPDTSKVMCVCRDNWHGSNRPWVSFDQNLDYQMGYICSGVFGDNPRPKDGKGSCGPVYVDGANGVKGFSYRYGNGVWIGRTKSNSSRQGFEMIWDPNGWTETDSNFFTKQDVVAVTDWSGYSGSFVQHPELTGLDCMRPCFWVELIRGRPKENTIWTSGSSISFCGVNSDTVDWSWPDGAELPFTIDK

SEQ ID NO: 14866 - protein, 469 aa, Artificial Sequence
  neuraminidase__InfluenzaA__ABD77832
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYGGRLVDSIGSWSKKILRTQESECVCINGTCTVVMTDGSASGRADTKILFIEEGKIVHISPLSGSAQHVEECSCYPRYSGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14867 - protein, 469 aa, Artificial Sequence
  neuraminidase__InfluenzaA__ABD77876
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYSGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14868 - protein, 469 aa, Artificial Sequence; identical to SEQ ID NO: 14126
  neuraminidase__InfluenzaA__ABD77887

SEQ ID NO: 14869 - protein, 469 aa, Artificial Sequence
  neuraminidase__InfluenzaA__ABD77898
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIIHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGSDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14870 - protein, 469 aa, Artificial Sequence
  neuraminidase__InfluenzaA__ABD77909
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNSSGYSGIFSVEGKSCINRCFYVELIRGRKQETEVWWTSNSIVVFCGTSGTYGTGSWPDGADINLMPI

SEQ ID NO: 14871 - protein, 470 aa, Artificial Sequence; identical to SEQ ID NO: 14828
  neuraminidase__InfluenzaA__ABD77920

SEQ ID NO: 14872 - protein, 470 aa, Artificial Sequence; identical to SEQ ID NO: 14828
  neuraminidase__InfluenzaA__ABD77931

SEQ ID NO: 14873 - protein, 470 aa, Artificial Sequence; identical to SEQ ID NO: 14828
  neuraminidase__InfluenzaA__ABD77942

SEQ ID NO: 14874 - protein, 470 aa, Artificial Sequence
  neuraminidase__InfluenzaA__ABD77953
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFLVELVRGLPRENTTIWTSGSSISFCGVNSDTANWSWPDGAELPFTIDK

SEQ ID NO: 14875 - protein, 470 aa, Artificial Sequence
  neuraminidase__InfluenzaA__ABD77964
MNPNQKIITIGSISIAIGIISLMLQIGNIISIWASHSIQTRSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 14876 - protein, 470 aa, Artificial Sequence; identical to SEQ ID NO: 14828
  neuraminidase__InfluenzaA__ABD77975

SEQ ID NO: 14877 - protein, 470 aa, Artificial Sequence; identical to SEQ ID NO: 14828
  neuraminidase__InfluenzaA__ABD77986

SEQ ID NO: 14878 - protein, 470 aa, Artificial Sequence
  neuraminidase__InfluenzaA__ABD77997
MNPNQKIITIGSISIAIGILSLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDNNFSVKQDVVAITDWSGYSGSFVQHPELTGLDCIRPCFWVELVRGLPRENTTIWTSGSSISFCGVNSDTANWSWPDGAELPFTIDK

SEQ ID NO: 14879 - protein, 470 aa, Artificial Sequence; identical to SEQ ID NO: 14828
  neuraminidase__InfluenzaA__ABD78008

SEQ ID NO: 14880 - protein, 470 aa, Artificial Sequence; identical to SEQ ID NO: 14828
  neuraminidase__InfluenzaA__ABD78019

SEQ ID NO: 14881 - protein, 470 aa, Artificial Sequence
  neuraminidase__InfluenzaA__ABD78030
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNRTVKDRSPYRALMSCPLGEAPSPYNSKFESVAWSASACHDGMGWLTIGISGPDNGAVAVLKYNGIITETIKSWKKRILRTQESECVCVNGSCFTIMTDGPNNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 14882 - protein, 470 aa, Artificial Sequence
  neuraminidase__InfluenzaA__ABD78041
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTSTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 14883 - protein, 469 aa, Artificial Sequence; identical to SEQ ID NO: 14862
  neuraminidase__InfluenzaA__ABD78052

SEQ ID NO: 14884 - protein, 470 aa, Artificial Sequence; identical to SEQ ID NO: 14396
  neuraminidase__InfluenzaA__ABD78063

SEQ ID NO: 14885 - protein, 470 aa, Artificial Sequence; identical to SEQ ID NO: 14396
  neuraminidase__InfluenzaA__ABD78074

SEQ ID NO: 14886 - protein, 470 aa, Artificial Sequence; identical to SEQ ID NO: 14396
  neuraminidase__InfluenzaA__ABD78085

SEQ ID NO: 14887 - protein, 470 aa, Artificial Sequence; identical to SEQ ID NO: 14396
  neuraminidase__InfluenzaA__ABD78096

SEQ ID NO: 14888 - protein, 469 aa, Artificial Sequence
  neuraminidase__InfluenzaA__ABD78118
MNPNQKIITIGSVSLTIATICFLMQIAILVTTVTLHFKQYECNSPPNNQVMLCEPTIIERNITEIVYLTNTTIEKEMCPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYSGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14889 - protein, 469 aa, Artificial Sequence; identical to SEQ ID NO: 14888
  neuraminidase__InfluenzaA__ABD78129

SEQ ID NO: 14890 - protein, 469 aa, Artificial Sequence; identical to SEQ ID NO: 14118
  neuraminidase__InfluenzaA__ABD79035

SEQ ID NO: 14891 - protein, 450 aa, Artificial Sequence
  neuraminidase__InfluenzaA__ABD79115
MNPNQKIITIGSICMVVGIISLIFQIGNIVSIWISHSITGTCNRSIYVNISNTNVVAGKDTTSVILAGNSSLCPIRGWAIYSKDNGVRIGSKGDVFVIREPFISCSHLECRTFFLTQGALLNDKHSNGTVKDRSPYRTLMSCPVGEAPSPYNSRFESVAWSASACHDGMGWLTIGISGPDDGAVAVLKYNGIITGTIKSWRKEILRTQESECVCVNGSCFTIMTDGPSGGPASYKIFKIEKGKVTKSIELDAPNSHYEECSCYPDTSKVMCVCRDNWHGSNRPWVSFDQNLDYQMGYICSGVFGDNPRPKDGKGSCGPVYVDGANGVKGFSYRYGNGVWIGRTKSSSSRQGFEMIWDPNGWTETDSNFFMKQDVVAVTDWSGYSGSFVQHPELTGLDCMRPCFWVELIRGRPKENTIWTSGSSISFCGVNSDTVDWSWPDGAELPFTIDK

SEQ ID NO: 14892 - protein, 469 aa, Artificial Sequence
  neuraminidase__InfluenzaA__ABD79126
MNPNQKIITIGSVSLTITTICFLMQIAILVITVTLHFKQCECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLDPNNEEGGHGVKGWAFDDGNDVWMGRTISEKLRSGYETFKVIGGWSKPNSKLQINRQVIVDKGNRSGYSGIFSVEGKSCINRCFYVELIRGRKQETEVWWTSNSIVVFCGTSGTYGTGSWPDGADINLMPI

SEQ ID NO: 14893 - protein, 469 aa, Artificial Sequence; identical to SEQ ID NO: 14892
  neuraminidase__InfluenzaA__ABD79137

SEQ ID NO: 14894 - protein, 469 aa, Artificial Sequence; identical to SEQ ID NO: 14892
  neuraminidase__InfluenzaA__ABD79148

SEQ ID NO: 14895 - protein, 469 aa, Artificial Sequence; identical to SEQ ID NO: 14892
  neuraminidase__InfluenzaA__ABD79159

SEQ ID NO: 14896 - protein, 469 aa, Artificial Sequence
  neuraminidase__InfluenzaA__ABD79170
MNPNQKIITIGSVSLTITTICFLMQIAILVITVTLHFKQCECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNNTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIKEGKIVHVSPLSGSAQHVEECSCYPRYPGVRCVCRDNWKGSNRPIVDINVKDYSIVSSYVCSGLVGDTPRKNDSSSSSYCLDPNNEEGGHGVKGWAFDDGNDVWMGRTISEKLRSGYETFKVIGGWSKPNSKLQINRQVIVDKGNRSGYSGIFSVEGKSCINRCFYVELIRGRKQETEVWWTSNSIVVFCGTSGTYGTGSWPDGADINLMPI

SEQ ID NO: 14897 - protein, 469 aa, Artificial Sequence; identical to SEQ ID NO: 14892
  neuraminidase__InfluenzaA__ABD79181

SEQ ID NO: 14898 - protein, 469 aa, Artificial Sequence; identical to SEQ ID NO: 14892
  neuraminidase__InfluenzaA__ABD79192

SEQ ID NO: 14899 - protein, 469 aa, Artificial Sequence
  neuraminidase__InfluenzaA__ABD79203
MNPNQKIITIGSVSLTITTICFLMQIAILVITVTLHFKQCECNSPPNNQVMLCEPTIIERNITEIVYLTNTTIEKEKCPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINMKDYSIVSSYVCSGLVGDTPRKNDSSSSSYCLDPNNEEGGHGVKGWAFDDGNDVWMGRTISEKLRSGYETFKVIGGWSKPNSKLQINRQVIVDKGNRSGYSGIFSVEGKSCINRCFYVELIRGRKQETEVWWTSNSIVVFCGTSGTYGTGSWPDGADINLMPI

SEQ ID NO: 14900 - protein, 469 aa, Artificial Sequence; identical to SEQ ID NO: 14892
  neuraminidase__InfluenzaA__ABD79214

SEQ ID NO: 14901 - protein, 469 aa, Artificial Sequence
  neuraminidase__InfluenzaA__ABD79236
MNPNQKIITIGSVSLTITTICFLMQIAILVITVTLHFKQCECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNNTAHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIKEGKIVHISPLSGSAQHVEECSCYPRYPGVRCVCRDNWKGSNRPIVDINVKDYSIVSSYVCSGLVGDTPRKNDSSSSSYCLDPNNEEGGHGVKGWAFDDGNDVWMGRTISEKLRSGYETFKVIGGWSKPNSKLQINRQVIVDKGNRSGYSGIFSVEGKSCINRCFYVELIRGRKQETEVWWTSNSIVVFCGTSGTYGTGSWPDGADINLMPI

SEQ ID NO: 14902 - protein, 469 aa, Artificial Sequence
  neuraminidase__InfluenzaA__ABD79247
MNPNQKIITIGSVSLTITTICFLMQIAILVITVTLHFKQCECNPPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLDPNNEEGGHGVKGWAFDDGNDVWMGRTISEKLRSGYETFKVMGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14903 - protein, 469 aa, Artificial Sequence; identical to SEQ ID NO: 14327
  neuraminidase__InfluenzaA__ABD94737

SEQ ID NO: 14904 - protein, 469 aa, Artificial Sequence; identical to SEQ ID NO: 14712
  neuraminidase__InfluenzaA__ABD94748

SEQ ID NO: 14905 - protein, 470 aa, Artificial Sequence; identical to SEQ ID NO: 14828
  neuraminidase__InfluenzaA__ABD94759

SEQ ID NO: 14906 - protein, 469 aa, Artificial Sequence; identical to SEQ ID NO: 14061
  neuraminidase__InfluenzaA__ABD94770

SEQ ID NO: 14907 - protein, 470 aa, Artificial Sequence; identical to SEQ ID NO: 14396
  neuraminidase__InfluenzaA__ABD94792

SEQ ID NO: 14908 - protein, 470 aa, Artificial Sequence; identical to SEQ ID NO: 14396
  neuraminidase__InfluenzaA__ABD94803

SEQ ID NO: 14909 - protein, 470 aa, Artificial Sequence; identical to SEQ ID NO: 14396
  neuraminidase__InfluenzaA__ABD94814

SEQ ID NO: 14910 - protein, 469 aa, Artificial Sequence; identical to SEQ ID NO: 14573
  neuraminidase__InfluenzaA__ABD94825

SEQ ID NO: 14911 - protein, 469 aa, Artificial Sequence
  neuraminidase__InfluenzaA__ABD94847
MNPNQKIITIGSVSLTIATICFLMQIAILVTTVTLHFKQYECNSPPNNQVMLCEPKIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRAVTKILFIEEGKIVHISPLLGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14912 - protein, 469 aa, Artificial Sequence; identical to SEQ ID NO: 14126
  neuraminidase__InfluenzaA__ABD94858

SEQ ID NO: 14913 - protein, 469 aa, Artificial Sequence; identical to SEQ ID NO: 14126
  neuraminidase__InfluenzaA__ABD94880

SEQ ID NO: 14914 - protein, 469 aa, Artificial Sequence
  neuraminidase__InfluenzaA__ABD94891
MNPNQKIITIGSVSLTITTICFLMQIAILVITVTLHFKQCECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKVLFIEEGKIVHISQLSGSAQHVEECSCYPRYPGVRCVCRDNWKGSNRPIVDINVKDYSIVSSYVCSGLVGDTPRKNDSSSSSYCLDPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14915 - protein, 469 aa, Artificial Sequence; identical to SEQ ID NO: 14892
  neuraminidase__InfluenzaA__ABD94902

SEQ ID NO: 14916 - protein, 469 aa, Artificial Sequence
  neuraminidase__InfluenzaA__ABD94924
MNPNQKIITIGSVSLTIATICLLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISQLLGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14917 - protein, 469 aa, Artificial Sequence
  neuraminidase__InfluenzaA__ABD94946
MNPNQKIITIGSVSLTIATICFLTQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDRSSSSHCLDPNNEEGGHGVKGWAFDDGNDVWMGRTISEKLRSGYETFKVIEGWSKPNSKLQINRQVIVDRDNRSGYSGIFSVEGKSCINRCFYVELIRGRNQETEVLWTSNSIVVFCGTSGTYGTGSWPDGADINLMPI

SEQ ID NO: 14918 - protein, 469 aa, Artificial Sequence
  neuraminidase__InfluenzaA__ABD94957
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVESKSCINRCFYVELIRGRKEETEVLWTSNSIVVFCGTSGTYGTGSWPDGADINLMPI

SEQ ID NO: 14919 - protein, 470 aa, Artificial Sequence; identical to SEQ ID NO: 14828
  neuraminidase__InfluenzaA__ABD94968

SEQ ID NO: 14920 - protein, 470 aa, Artificial Sequence; identical to SEQ ID NO: 14828
  neuraminidase__InfluenzaA__ABD94990

SEQ ID NO: 14921 - protein, 470 aa, Artificial Sequence
  neuraminidase__InfluenzaA__ABD95001
MNPNQKIITIGSISIAIGIISLMLQIGNIISIWASHSIQTGSQNHTGICNQRIITYENSTWVNHTYVNIHNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSMKQDVVAITDWSGYSGSFVQHPELTGLDCIRPCFWVELVRGLPRENTTIWTSGSSISFCGVNSDTANWSWPDGAELPFTIDK

SEQ ID NO: 14922 - protein, 470 aa, Artificial Sequence
  neuraminidase__InfluenzaA__ABD95012
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 14923 - protein, 470 aa, Artificial Sequence; identical to SEQ ID NO: 14828
  neuraminidase__InfluenzaA__ABD95023

SEQ ID NO: 14924 - protein, 470 aa, Artificial Sequence
  neuraminidase__InfluenzaA__ABD95034
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFIQHPELTGLDCIRPCFWVELVRGLPRENTTIWTSGSSISFCGVNSDTANWSWPDGAELPFTIDK

SEQ ID NO: 14925 - protein, 470 aa, Artificial Sequence
  neuraminidase__InfluenzaA__ABD95056
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKITKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLNCIRPCFWVELVRGLPKENTTIWTSGSSISFCGVNSDTANWSWPDGAELPFTIDK

SEQ ID NO: 14926 - protein, 470 aa, Artificial Sequence; identical to SEQ ID NO: 14396
  neuraminidase__InfluenzaA__ABD95067

SEQ ID NO: 14927 - protein, 470 aa, Artificial Sequence; identical to SEQ ID NO: 14396
  neuraminidase__InfluenzaA__ABD95078

SEQ ID NO: 14928 - protein, 470 aa, Artificial Sequence; identical to SEQ ID NO: 14925
  neuraminidase__InfluenzaA__ABD95089

SEQ ID NO: 14929 - protein, 470 aa, Artificial Sequence; identical to SEQ ID NO: 14396
  neuraminidase__InfluenzaA__ABD95100

SEQ ID NO: 14930 - protein, 470 aa, Artificial Sequence
  neuraminidase__InfluenzaA__ABD95111
MNPNQKIITIGSISIAIGMISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14931 - protein, 470 aa, Artificial Sequence; identical to SEQ ID NO: 14930
  neuraminidase__InfluenzaA__ABD95122

SEQ ID NO: 14932 - protein, 470 aa, Artificial Sequence; identical to SEQ ID NO: 14396
  neuraminidase__InfluenzaA__ABD95144

SEQ ID NO: 14933 - protein, 470 aa, Artificial Sequence; identical to SEQ ID NO: 14396
  neuraminidase__InfluenzaA__ABD95155

SEQ ID NO: 14934 - protein, 470 aa, Artificial Sequence
  neuraminidase__InfluenzaA__ABD95166
MNPNQKIITIGSISIAIGMISLMLQIGNIISIWASHSIQTGSQNHTGVCNQRIITYENSTWVNHTYVNINNTNVIAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14935 - protein, 470 aa, Artificial Sequence; identical to SEQ ID NO: 14925
  neuraminidase__InfluenzaA__ABD95177

SEQ ID NO: 14936 - protein, 470 aa, Artificial Sequence
  neuraminidase__InfluenzaA__ABD95188
MNPNQKIITIGSISTTIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14937 - protein, 470 aa, Artificial Sequence; identical to SEQ ID NO: 14925
  neuraminidase__InfluenzaA__ABD95199

SEQ ID NO: 14938 - protein, 470 aa, Artificial Sequence; identical to SEQ ID NO: 14415
  neuraminidase__InfluenzaA__ABD95210

SEQ ID NO: 14939 - protein, 470 aa, Artificial Sequence
  neuraminidase__InfluenzaA__ABD95221
MNPNQKIITIGSISIAIGMISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNSHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14940 - protein, 470 aa, Artificial Sequence; identical to SEQ ID NO: 14930
  neuraminidase__InfluenzaA__ABD95232

SEQ ID NO: 14941 - protein, 470 aa, Artificial Sequence; identical to SEQ ID NO: 14396
  neuraminidase__InfluenzaA__ABD95243

SEQ ID NO: 14942 - protein, 470 aa, Artificial Sequence; identical to SEQ ID NO: 14930
  neuraminidase__InfluenzaA__ABD95254

SEQ ID NO: 14943 - protein, 470 aa, Artificial Sequence; identical to SEQ ID NO: 14415
  neuraminidase__InfluenzaA__ABD95265

SEQ ID NO: 14944 - protein, 470 aa, Artificial Sequence; identical to SEQ ID NO: 14396
  neuraminidase__InfluenzaA__ABD95276

SEQ ID NO: 14945 - protein, 470 aa, Artificial Sequence
  neuraminidase__InfluenzaA__ABD95287
MNPNQKIITIGSISVAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14946 - protein, 470 aa, Artificial Sequence; identical to SEQ ID NO: 14396
  neuraminidase__InfluenzaA__ABD95298

SEQ ID NO: 14947 - protein, 470 aa, Artificial Sequence
  neuraminidase__InfluenzaA__ABD95309
MNPNQKIITIGSISIAIGMISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKCNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 14948 - protein, 470 aa, Artificial Sequence; identical to SEQ ID NO: 14396
  neuraminidase__InfluenzaA__ABD95320

SEQ ID NO: 14949 - protein, 470 aa, Artificial Sequence; identical to SEQ ID NO: 14925
  neuraminidase__InfluenzaA__ABD95331

SEQ ID NO: 14950 - protein, 470 aa, Artificial Sequence
  neuraminidase__InfluenzaA__ABD95342
MNPNQKIITIGSICMAIGIISLILQIGNIISIWVSHSIQTGSQNHTGICNQRIITYENSTWVNQTYVNINNTNVVAGKDTTSVTLAGNSSLCPVRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCINGSCFTIMTDGPSNGPASYRIFKIEKGKITKSIELDAPNSHYEECSCYPDTGTVMCVCRDNWHGSNRPWVSFNQNLDYQIGYICSGVFGDNPRPKDGKGSCGPVTVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 14951 - protein, 470 aa, Artificial Sequence
  neuraminidase__InfluenzaA__ABD95353
MNPNQKIITIGSICMAIGIISLILQIGNIISIWVSHSIQTGSQNHTGICNQRIITYENSTWVNQTYVNISNTNVVAGKDTTSMTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKQILRTQESECVCVNGSCFTIMTDGPSDGPASYRIFKIEKGKITKSIELDAPNSHYEECSCYPDTGTVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 14952 - protein, 470 aa, Artificial Sequence; identical to SEQ ID NO: 14828
  neuraminidase__InfluenzaA__ABE11660

SEQ ID NO: 14953 - protein, 470 aa, Artificial Sequence
  neuraminidase__InfluenzaA__ABE11671
MNPNQKIITIGSISIAIGIISLMLQIGNIISIWASHSIQTGSQNHTGVCNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVNKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 14954 - protein, 470 aa, Artificial Sequence
  neuraminidase__InfluenzaA__ABE11682
MNPNQKIITIGSISIAIGIISLMLQIGNIISIWASHSIQTGSQNHTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 14955 - protein, 470 aa, Artificial Sequence; identical to SEQ ID NO: 14396
  neuraminidase__InfluenzaA__ABE11693

SEQ ID NO: 14956 - protein, 470 aa, Artificial Sequence; identical to SEQ ID NO: 14396
  neuraminidase__InfluenzaA__ABE11704

SEQ ID NO: 14957 - protein, 470 aa, Artificial Sequence; identical to SEQ ID NO: 14396
  neuraminidase__InfluenzaA__ABE11715

SEQ ID NO: 14958 - protein, 470 aa, Artificial Sequence; identical to SEQ ID NO: 14925
  neuraminidase__InfluenzaA__ABE11726

SEQ ID NO: 14959 - protein, 470 aa, Artificial Sequence; identical to SEQ ID NO: 14930
  neuraminidase__InfluenzaA__ABE11737

SEQ ID NO: 14960 - protein, 470 aa, Artificial Sequence; identical to SEQ ID NO: 14396
  neuraminidase__InfluenzaA__ABE11815

SEQ ID NO: 14961 - protein, 470 aa, Artificial Sequence; identical to SEQ ID NO: 14925
  neuraminidase__InfluenzaA__ABE11826

SEQ ID NO: 14962 - protein, 470 aa, Artificial Sequence; identical to SEQ ID NO: 14925
  neuraminidase__InfluenzaA__ABE11837

SEQ ID NO: 14963 - protein, 470 aa, Artificial Sequence; identical to SEQ ID NO: 14925
  neuraminidase__InfluenzaA__ABE11848

SEQ ID NO: 14964 - protein, 470 aa, Artificial Sequence; identical to SEQ ID NO: 14930
  neuraminidase__InfluenzaA__ABE11859

SEQ ID NO: 14965 - protein, 470 aa, Artificial Sequence
  neuraminidase__InfluenzaA__ABE11903
MNPNQKIITIGSISMAIGIISLILQIGNIISIWASHSIQTGSQNYTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKQILRTQESECVCVNGSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 14966 - protein, 470 aa, Artificial Sequence
  neuraminidase__InfluenzaA__ABE11925
MNPNQKIITIGSISIAIGIISLILQIGNIISIWASHSIQTGSQNHTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGKVTKSIELDAPNYHYEECSCYPDTGTVMCVCRDNWHGSNRPWVSFNQNLDYQIGYICSGVFGDNPRPKDGEGSCNPVTADGADGVKGFSYRYGNGVWIGRTKSNRLRKGFEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 14967 - protein, 470 aa, Artificial Sequence
  neuraminidase__InfluenzaA__ABE11952
MNPNQKIITIGSISMAIGIISLILQIGNIISIWASHSIQTGSQNYTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKQILRTQESECVCVNGSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETADWSWPDGAELPFTIDK

SEQ ID NO: 14968 - protein, 470 aa, Artificial Sequence
  neuraminidase__InfluenzaA__ABE12035
MNPNQKIITIGSISIAIGIISLILQIGNIISIWASHSIQTGSQNHTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 14969 - protein, 469 aa, Artificial Sequence; identical to SEQ ID NO: 14730
  neuraminidase__InfluenzaA__ABE12094

SEQ ID NO: 14970 - protein, 469 aa, Artificial Sequence; identical to SEQ ID NO: 14862
  neuraminidase__InfluenzaA__ABE12126

SEQ ID NO: 14971 - protein, 470 aa, Artificial Sequence; identical to SEQ ID NO: 14396
  neuraminidase__InfluenzaA__ABE12263

SEQ ID NO: 14972 - protein, 469 aa, Artificial Sequence
  neuraminidase__InfluenzaA__ABE12626
MNPNQKIITIGSVSLTIATICFLMQIAILVTTVTLHFKQYECDSPANNQVMPCEPIIIERNITEIVYLTNTTIEKEICPKLVEYRKWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINVKDYSIDSSYVCSGLVGDTPRNNDRSSNSYCRNPNNERGNHGVKGWAFDDGNDVWMGRTISKDSRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 14973 - protein, 469 aa, Artificial Sequence
  neuraminidase__InfluenzaA__ABE12650
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIKEGKIVHISPLLGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14974 - protein, 469 aa, Artificial Sequence
  neuraminidase__InfluenzaA__ABE13095
MNPNQKIITIGSVSLTITTICFLMQIAILVITVTLHFKQCECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDGSSSSYCLDPNNEEGGHGVKGWAFDDGNDVWMGRTISEKLRSGYETFKVIGGWSKPNSKLQINRQVIVDKGNRSGYSGIFSVEGKSCINRCFYVELIRGRKQETEVWWTSNSIVVFCGTSGTYGTGSWPDGADINLMPI

SEQ ID NO: 14975 - protein, 469 aa, Artificial Sequence; identical to SEQ ID NO: 14126
  neuraminidase__InfluenzaA__ABE13332

SEQ ID NO: 14976 - protein, 469 aa, Artificial Sequence; identical to SEQ ID NO: 14126
  neuraminidase__InfluenzaA__ABE13558

SEQ ID NO: 14977 - protein, 469 aa, Artificial Sequence
  neuraminidase__InfluenzaA__ABE13642
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHERTPYRTLLMNELGVPFHLGTKQVCIAWSSSSCHDGKAWLHVCVTGHDENATASFIYNGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14978 - protein, 469 aa, Artificial Sequence
  neuraminidase__InfluenzaA__ABE13668
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14979 - protein, 469 aa, Artificial Sequence
  neuraminidase__InfluenzaA__ABE13836
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14980 - protein, 469 aa, Artificial Sequence
  neuraminidase__InfluenzaA__ABE14033
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14981 - protein, 469 aa, Artificial Sequence
  neuraminidase__InfluenzaA__ABE14055
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSISSWSKNILRTQESECVCINGTCTVVMTDGSSSGRADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCVNRCFYVELIRGRKQETEVWWTSNSIVVFCGTSGTYGTGSWPDGADINLMPI

SEQ ID NO: 14982 - protein, 469 aa, Artificial Sequence
  neuraminidase__InfluenzaA__ABE14857
MNPNQKIITIGSVSLTIATICFLMQIAILVTTVTLHFKQYECNSPPNNQVMLCEPTIIERNTTEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 14983 - protein, 469 aa, Artificial Sequence; identical to SEQ ID NO: 14980
  neuraminidase__InfluenzaA__ABE15594

SEQ ID NO: 14984 - protein, 470 aa, Artificial Sequence
  neuraminidase__InfluenzaA__ABE26994
MNPNQKIITIGSISIAIGIISLILQIGNIISIWASHSIQTGSQNHTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGRVTKSIELDAPNYHYEECSCYPDTGTVMCVCRDNWHSSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 14985 - protein, 449 aa, Artificial Sequence
  neuraminidase__InfluenzaA__ABE97641
MNPNQKIITIGSICMVIGIISLMLQIGNMISIWVSHSIQTWNQHQAESISNTNPLTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWISFNQNLEYQIGYICSGVFGDNPRPNDGTGSCGPMSPNGAYGVKGFSFKYGNGVWIGRTKSTNSRSGFEMIWDPNGWIGTDSSFSVKQDIVAITDWSGYSGSFVQHPELTGLDCIRPCFWVELIRGRPKESTIWTSGSSISFCGVNSDIVSWSWPDGAELPFTIDK

SEQ ID NO: 14986 - protein, 449 aa, Artificial Sequence
  neuraminidase__InfluenzaA__ABE97642
MNPNQKIITIGSICMVIGMVSLMLQIGNMISIWLSHSIQTGNQHQAESISNNNLLTENAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGISWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFIIDK

SEQ ID NO: 14987 - protein, 449 aa, Artificial Sequence
  neuraminidase__InfluenzaA__ABE97644
MNPNQKIITIGSICMVIGIVSLMLQIGNMISIWVSHSIQTGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVALTDWSGYSGSFVQHPELTGLDCIRPCFWVELIRGRPKESTIWTSGSSISFCGVNSDTVSWSWPDGAELPFTIDK

SEQ ID NO: 14988 - protein, 449 aa, Artificial Sequence
  neuraminidase__InfluenzaA__ABE97645
MNPNQKIITIGSICMVIGTVSLMLQIGNMISIWVSHSIQTGNQHQAEPTSSTNPLTEKAVASVTLAGNSSLCPIRGWAIHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFAFKYGNGVWIGRTKSTNSRSGFEMIWDPNGWTGPDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 14989 - protein, 449 aa, Artificial Sequence
  neuraminidase__InfluenzaA__ABE97646
MNPNQKIITIGSICMVIGIVSLMLQIGNMISIWVSHSIQTENQHQAESISNTNPPTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNTLRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVSITDWSGYSGSFVQHPELTGLDCIRPCFWVELIRGRPKESTIWTSGSSISFCGVNSDTVSWSWPDGAELPFTIDK

SEQ ID NO: 14990 - protein, 449 aa, Artificial Sequence
  neuraminidase__InfluenzaA__ABE97647
MNPNQKIITIGSICMVIGIVSLMLQIGNMISIWVSHSIQTGNQHRAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 14991 - protein, 449 aa, Artificial Sequence
  neuraminidase__InfluenzaA__ABE97649
MNPNQKIITIGSICMVIGIVSLMLQIGNMISIWVSHSIQTGNQHQAESISNTNPLTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 14992 - protein, 449 aa, Artificial Sequence; identical to SEQ ID NO: 14991
  neuraminidase__InfluenzaA__ABE97651

SEQ ID NO: 14993 - protein, 449 aa, Artificial Sequence; identical to SEQ ID NO: 14991
  neuraminidase__InfluenzaA__ABE97653

SEQ ID NO: 14994 - protein, 449 aa, Artificial Sequence; identical to SEQ ID NO: 14991
  neuraminidase__InfluenzaA__ABE97654

SEQ ID NO: 14995 - protein, 449 aa, Artificial Sequence
  neuraminidase__InfluenzaA__ABE97655
MNPNQKIITIGSICMAIGIVSLMLQIGNMISIWVSHSIQTGNQHQAESTSNTNPLTEKAVASVTLAGNSSLCPIRGWAIHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFAFKYGNGVWIGRTKSTNSRSGFEMIWDPNGWTGPDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 14996 - protein, 449 aa, Artificial Sequence
  neuraminidase__InfluenzaA__ABE97657
MNPNQKIITIGSICMVIGTVSLVLQIGNMISIWVSHSIQTGNQHQAESISNTNPLTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRDNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSSNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 14997 - protein, 449 aa, Artificial Sequence
  neuraminidase__InfluenzaA__ABE97658
MNPNQKIITIGSICMVIGTISLMLQIGNMISIWVSHSIQTGNQHQTESISNTNPLTEKAVASVTLAGNSSLCSIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRDNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSSNGAHGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 14998 - protein, 449 aa, Artificial Sequence
  neuraminidase__InfluenzaA__ABE97659
MNPNQKIITIGSICMVIGIVSLMLQIGNMISIWVSHSIQTGNQHQAESISNTNPLTEKAVASVTLAGNSSLCPIRGWAVHSKDNSIRIGSKGDVFVIREPFISCSHLECRTFFLTQGALLNDKHSNETVKDRSPHRTLMSCPVGEAPSPYNSRFESVAWSASACHDGTSWLTIGISGPDNGAVAVLKYNGIITDTIKSWRDNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSSNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 14999 - protein, 449 aa, Artificial Sequence
  neuraminidase__InfluenzaA__ABE97660
MNPNQKIITIGSICMVIGTISLMLQIGNMISIWVSHSIQTGNQHQAESISNTNPLTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRDNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSSNGAHGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15000 - protein, 449 aa, Artificial Sequence
  neuraminidase__InfluenzaA__ABE97661
MNPNQKIITIGSICMVIGTISLMLQIGNMISIWVSHSIQTGNQHQTESISNTNPLTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRDNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSSNGAHGVKGFSFKYGNGVWIGRTKSTNSRSGFEMIWDPNGWTGTDSSFSVKQDIVATTDWSGYSGSFVQHPELTGLDCIRPCFWVELIRGRPKESTVWTSGSSISFCGVNSDTVSWSWPDGAELPFTIDK

SEQ ID NO: 15001 - protein, 449 aa, Artificial Sequence
  neuraminidase__InfluenzaA__ABE97662
MNPNQKIITIGSICMVIGIVSLMLQIGNMISIWVSHSIQTGNQHQAESISNTNPLTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMRKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15002 - protein, 449 aa, Artificial Sequence
  neuraminidase__InfluenzaA__ABE97663
MNPNQKIITIGSICMVTGIVSLMLQIGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFRYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15003 - protein, 449 aa, Artificial Sequence
  neuraminidase__InfluenzaA__ABE97665
MNPNQKIITIGSICMVTGIVSLMLQVGNMISIWVSHSIHTGNQHQAEPISNTNFLTEKAVASVKLAGNSSLCPINGWAVYSKDNSIRIGSKGDVFVIREPFISCSHLECRTFFLTHGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15004 - protein, 449 aa, Artificial Sequence
  neuraminidase__InfluenzaA__ABE97666
MNPNQKIITIGSICMVTGIVSLMLQIGNMISIWVSHSIHTGNQHQSEPISNTNFLTEKAVASVKLAGNSPLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDSPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15005 - protein, 449 aa, Artificial Sequence
  neuraminidase__InfluenzaA__ABE97667
MNPNQKIITIGSICMVTGIVSLMLQIGNMISIWGSHSIHTGNQHQSEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVVKYNGIITDTIKSWRNNILRTQESECACVNGSCFTVMTDGPSNGQASHKIFKMEKGKVVKSVELDAPNYHYEECSCYPDAGKITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDIVGWSWPDGAELPFTIDK

SEQ ID NO: 15006 - protein, 449 aa, Artificial Sequence
  neuraminidase__InfluenzaA__ABE97669
MNPNQKIITIGSICMVTGIVSLMLQIGNMISIWVSHSIHTGNQHQSEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVVKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15007 - protein, 449 aa, Artificial Sequence
  neuraminidase__InfluenzaA__ABE97670
MNPNQKIITIGSICMVTGIVSLMLQIGNMISIWVSHSIHTGNQHQSEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVVKYNGIITDTIKSWRNNILRTQESECACVNGSCFTVMTDGPSNGQASHKIFKMEKGKVVKSVELDTPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15008 - protein, 449 aa, Artificial Sequence
  neuraminidase__InfluenzaA__ABE97671
MNPNQKIITIGSICMVTGIVSLMLQIGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15009 - protein, 449 aa, Artificial Sequence
  neuraminidase__InfluenzaA__ABE97672
MNPNQKIITIGSICMVTGIVSLMLQIGNMISIWVSHSIHTGNQHQAEPISNTNFLTEKALASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15010 - protein, 449 aa, Artificial Sequence
  neuraminidase__InfluenzaA__ABE97675
MNPNQKIITIGSICMVTGIVSLMLQVGNMISIWVSHSIHTGNQHQAEPISNTNFLIEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKIEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWSETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15011 - protein, 449 aa, Artificial Sequence
  neuraminidase__InfluenzaA__ABE97676
MNPNQKIITIGSICMVTGIVSLMLQIGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAINDWSGYSGSFVQHPELTGLDCIRPCFWVELIRGRPKESTIWTSGSSISFCGVNSDTVGWSWPDGAELPFTIDK

SEQ ID NO: 15012 - protein, 449 aa, Artificial Sequence
  neuraminidase__InfluenzaA__ABE97677
MNPNQKIITIGSICMVTGIVSLMLQIGNIISIWVRHSIHTGNQHQSEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVVKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15013 - protein, 449 aa, Artificial Sequence
  neuraminidase__InfluenzaA__ABE97679
MNPNQKIITIGSICMVTGIVSLMLQIGNMISIWVRHSIHTGNQHQSEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVVKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15014 - protein, 449 aa, Artificial Sequence; identical to SEQ ID NO: 15006
  neuraminidase__InfluenzaA__ABE97680

SEQ ID NO: 15015 - protein, 449 aa, Artificial Sequence; identical to SEQ ID NO: 15006
  neuraminidase__InfluenzaA__ABE97681

SEQ ID NO: 15016 - protein, 449 aa, Artificial Sequence; identical to SEQ ID NO: 15006
  neuraminidase__InfluenzaA__ABE97682

SEQ ID NO: 15017 - protein, 449 aa, Artificial Sequence
  neuraminidase__InfluenzaA__ABE97684
MNPNQKIITIGSICMVTGIVSLMLQIGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSGTVGWSWPDGAELPFTIDK

SEQ ID NO: 15018 - protein, 449 aa, Artificial Sequence
  neuraminidase__InfluenzaA__ABE97685
MNPNQKIITIGSICMVTGIVSLMLQIGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTGGWSWPDGAELPFTIDK

SEQ ID NO: 15019 - protein, 449 aa, Artificial Sequence; identical to SEQ ID NO: 15008
  neuraminidase__InfluenzaA__ABE97686

SEQ ID NO: 15020 - protein, 449 aa, Artificial Sequence
  neuraminidase__InfluenzaA__ABE97687
MNPNQKIITIGSICMVTGIVSLMLQVGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15021 - protein, 449 aa, Artificial Sequence
  neuraminidase__InfluenzaA__ABE97688
MNPNQKIITIGSICMVTGIVSLMLQVGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVIKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWVGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFIIDK

SEQ ID NO: 15022 - protein, 449 aa, Artificial Sequence
  neuraminidase__InfluenzaA__ABE97690
MNPNQKIITIGSICMVTGIVSLMLQVGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRSLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMKKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15023 - protein, 449 aa, Artificial Sequence
  neuraminidase__InfluenzaA__ABE97691
MNPNQKIITIGSICMVTGIVSLMLQVGNMISIWVSHSIHTGNQHQAEPISNTNFLTEKAVASVKLAGNSSLCPINGWAVYSKDNSIRIGSKGDVFVKREPCISCSHLKCRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15024 - protein, 449 aa, Artificial Sequence
  neuraminidase__InfluenzaA__ABE97694
MNPNQKIMTIGSICMVTGIVSLMLQVGNMISIWVSHSIHTGNQHQAEPISNTNFLTEKAVDSVKLAGNSSLCPINGWAVYSKDNSIRIGSKGDVFVIREPSVSCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDVVAITDWSGYSGSFVQHPELTGLDCIRPCFWVELIRGRPKESTIWTSGSSISFCGVNSDTVGWSWPDGAELPFTIDK

SEQ ID NO: 15025 - protein, 449 aa, Artificial Sequence
  neuraminidase__InfluenzaA__ABE97696
MNPNQKIITIGSICMVTGIVSLMLQVGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGSVKDRSPHRTLMSCSVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15026 - protein, 449 aa, Artificial Sequence
  neuraminidase__InfluenzaA__ABE97697
MNPNQKIITIGSICMVTGIVSLMLQVGNMISIWVSHSIHTGNQHQAEPISNTNFLNEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDETGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15027 - protein, 449 aa, Artificial Sequence
  neuraminidase__InfluenzaA__ABE97702
MNPNQKIITIGSICMVTGIVSLMLQVGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPYYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVSITDWSGYSGSFVQHPELTGLDCIRPCFWVELIRGRPKESTIWTSGSSISFCGVNSDTVGWSWPDGAELPFTTDK

SEQ ID NO: 15028 - protein, 449 aa, Artificial Sequence; identical to SEQ ID NO: 15020
  neuraminidase__InfluenzaA__ABE97703

SEQ ID NO: 15029 - protein, 449 aa, Artificial Sequence; identical to SEQ ID NO: 15020
  neuraminidase__InfluenzaA__ABE97705

SEQ ID NO: 15030 - protein, 449 aa, Artificial Sequence
  neuraminidase__InfluenzaA__ABE97706
MNPNQKIITIGSICMVTGIVSLMLQVGNMISLWVSHSIHTGNQHQAEPISNTNFLTERAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTSSRSGFEMIWDPNGWTETDSSFSVKQDIVAITDWSGYSGSFVQHPELTGLDCIRPCFWVELIRGRPKESTIWASGSSISFCGVNSDTVGWSWPDGAELPFTIDK

SEQ ID NO: 15031 - protein, 449 aa, Artificial Sequence
  neuraminidase__InfluenzaA__ABE97707
MNPNQKIITIGSICMVTGIVSLMLQVGNMISIWVSHSIHTGNQHQAEPISNTNFLTEKAVASVKLAGNSSLCPIKGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15032 - protein, 449 aa, Artificial Sequence
  neuraminidase__InfluenzaA__ABE97708
MNPNQKIITIGSICMVTGIVSLMLQVGNMISIWVSHSIHTGNQHQAEPISNTNFLTEKAVASVKLAGNSSLCPINGWAVYSKDNSIRIGSKGDVFVIREPFISCSHLECRTFFLTHGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMKKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15033 - protein, 449 aa, Artificial Sequence
  neuraminidase__InfluenzaA__ABE97710
MNPNQKIITIGSICMVTGIVSLMLQVGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELNAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSLKQDIVAITDWSGYSGSFVQHPELTGLDCIRPCFWVELIRGRPKESTIWTSGSSISFCGVNSDTVGWSWPDGAELPFTIDK

SEQ ID NO: 15034 - protein, 449 aa, Artificial Sequence
  neuraminidase__InfluenzaA__ABE97711
MNPNQKIITIGSICMVTGIVSLMLQVGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSDGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMVWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15035 - protein, 449 aa, Artificial Sequence; identical to SEQ ID NO: 15020
  neuraminidase__InfluenzaA__ABE97712

SEQ ID NO: 15036 - protein, 449 aa, Artificial Sequence; identical to SEQ ID NO: 15020
  neuraminidase__InfluenzaA__ABE97713

SEQ ID NO: 15037 - protein, 449 aa, Artificial Sequence; identical to SEQ ID NO: 15020
  neuraminidase__InfluenzaA__ABE97715

SEQ ID NO: 15038 - protein, 449 aa, Artificial Sequence
  neuraminidase__InfluenzaA__ABE97717
MNPNQKIITIGSICMVTGIVNLMLQVGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVPSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15039 - protein, 449 aa, Artificial Sequence
  neuraminidase__InfluenzaA__ABE97718
MNPNQKIITIGSICMVTGIVSLMLQVGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVDSDTVGWSWPDGAELPFTIDK

SEQ ID NO: 15040 - protein, 449 aa, Artificial Sequence
  neuraminidase__InfluenzaA__ABE97719
MNPNQKIITIGSICMVTGIVSLMLQVGNMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMKKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15041 - protein, 449 aa, Artificial Sequence
  neuraminidase__InfluenzaA__ABE97720
MNPNQKIITIGSICMVTGIVSLMLQVGNMISIWVSHSIHTGNQHQAEPISNANFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDTPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15042 - protein, 469 aa, Artificial Sequence; identical to SEQ ID NO: 14813
  neuraminidase__InfluenzaA__ABF47553

SEQ ID NO: 15043 - protein, 470 aa, Artificial Sequence; identical to SEQ ID NO: 14396
  neuraminidase__InfluenzaA__ABF47564

SEQ ID NO: 15044 - protein, 470 aa, Artificial Sequence
  neuraminidase__InfluenzaA__ABF47575
MNPNQKIITIGSISIAIGIISLMLQIGNIISIWASHSIQTGSQNHTGVCNQRIITYENSTWVNHTYVNINNTNVIAGKDKTSVALAGNSSLCSISGWAIYTKDNSIRIGSKGDVFVIREPFISCSHFECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 15045 - protein, 470 aa, Artificial Sequence; identical to SEQ ID NO: 14396
  neuraminidase__InfluenzaA__ABF47586

SEQ ID NO: 15046 - protein, 469 aa, Artificial Sequence; identical to SEQ ID NO: 14126
  neuraminidase__InfluenzaA__ABF47597

SEQ ID NO: 15047 - protein, 470 aa, Artificial Sequence; identical to SEQ ID NO: 14968
  neuraminidase__InfluenzaA__ABF47608

SEQ ID NO: 15048 - protein, 469 aa, Artificial Sequence
  neuraminidase__InfluenzaA__ABF47619
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSASSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15049 - protein, 470 aa, Artificial Sequence
  neuraminidase__InfluenzaA__ABF47630
MNPNQKIITIGSISIAIGIISLILQIGNIISIWASHSIQTGSQNHTGICNQRIITYENSTWVNQTYVNINNTNVVAGKDKTSMALAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 15050 - protein, 470 aa, Artificial Sequence
  neuraminidase__InfluenzaA__ABF47652
MNPNQKIITIGSISIAIGIISLILQIGNIISIWASHSIQTGSQNHTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGRVTKSIELDAPNYHYEECSCYPNTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 15051 - protein, 470 aa, Artificial Sequence; identical to SEQ ID NO: 14968
  neuraminidase__InfluenzaA__ABF47663

SEQ ID NO: 15052 - protein, 470 aa, Artificial Sequence
  neuraminidase__InfluenzaA__ABF47674
MNPNQKIITIGSISIAIGIISLMLQIGNIISIWASHSIQTGSQNHTGVCIQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 15053 - protein, 470 aa, Artificial Sequence; identical to SEQ ID NO: 14951
  neuraminidase__InfluenzaA__ABF47696

SEQ ID NO: 15054 - protein, 470 aa, Artificial Sequence
  neuraminidase__InfluenzaA__ABF47707
MNPNQKIITIGSICMAIGIISLILQIGNIISIWVSHSIQTGSQNHTGICNQRIITYENSTWVNQTYVNISNTNVVAGKGTTSMTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKQILRTQESECVCVNGSCFTIMTDGPSDGPASYRIFKIEKGKITKSIELDAPNSHYEECSCYPDTGTVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 15055 - protein, 470 aa, Artificial Sequence; identical to SEQ ID NO: 14951
  neuraminidase__InfluenzaA__ABF47718

SEQ ID NO: 15056 - protein, 470 aa, Artificial Sequence; identical to SEQ ID NO: 14951
  neuraminidase__InfluenzaA__ABF47729

SEQ ID NO: 15057 - protein, 470 aa, Artificial Sequence; identical to SEQ ID NO: 14951
  neuraminidase__InfluenzaA__ABF47740

SEQ ID NO: 15058 - protein, 470 aa, Artificial Sequence
  neuraminidase__InfluenzaA__ABF47751
MNPNQKIITIGSICMAIGIISLILQIGNIISIWVSHSIQTGSQNHTGICNQRIITYENSTWVNQTYVNINNTNVVAGKDTTSVTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSNGPASYRIFKIEKGKITKSIELDAPNSHYEECSCYPDTGTVMCVCRDNWHGSNRPWVSFNQNLDYQIGYICSGVFGDNPRPKDGKGSCDPVTVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTANWSWPDGAELPFTIDK

SEQ ID NO: 15059 - protein, 470 aa, Artificial Sequence
  neuraminidase__InfluenzaA__ABF47773
MNPNQKIITIGSICMTIGIISLILQIGNIISIWVSHSIQTGSQNHTGICNQRIITYENSTWVNQTYVNINNTNVVAGKDTTSVTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSNGPASYRIFKIEKGKITKSIELDAPNSHYEECSCYPDTGTVMCVCRDNWHGSNRPWVSFNQNLDYQIGYICSGVFGDNPRPKDGKGSCDPVTVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTANWSWPDGAELPFTIDK

SEQ ID NO: 15060 - protein, 470 aa, Artificial Sequence; identical to SEQ ID NO: 15059
  neuraminidase__InfluenzaA__ABF47784

SEQ ID NO: 15061 - protein, 470 aa, Artificial Sequence; identical to SEQ ID NO: 15059
  neuraminidase__InfluenzaA__ABF47795

SEQ ID NO: 15062 - protein, 470 aa, Artificial Sequence; identical to SEQ ID NO: 15059
  neuraminidase__InfluenzaA__ABF47806

SEQ ID NO: 15063 - protein, 470 aa, Artificial Sequence; identical to SEQ ID NO: 15059
  neuraminidase__InfluenzaA__ABF47817

SEQ ID NO: 15064 - protein, 470 aa, Artificial Sequence; identical to SEQ ID NO: 15059
  neuraminidase__InfluenzaA__ABF47839

SEQ ID NO: 15065 - protein, 470 aa, Artificial Sequence; identical to SEQ ID NO: 15059
  neuraminidase__InfluenzaA__ABF47850

SEQ ID NO: 15066 - protein, 470 aa, Artificial Sequence; identical to SEQ ID NO: 14828
  neuraminidase__InfluenzaA__ABF47872

SEQ ID NO: 15067 - protein, 470 aa, Artificial Sequence; identical to SEQ ID NO: 14828
  neuraminidase__InfluenzaA__ABF47883

SEQ ID NO: 15068 - protein, 470 aa, Artificial Sequence; identical to SEQ ID NO: 14828
  neuraminidase__InfluenzaA__ABF47894

SEQ ID NO: 15069 - protein, 469 aa, Artificial Sequence; identical to SEQ ID NO: 14844
  neuraminidase__InfluenzaA__ABF47905

SEQ ID NO: 15070 - protein, 453 aa, Artificial Sequence
  neuraminidase__InfluenzaA__ABF47958
MNPNQKIITIGSICMVVGIISLILQIGNIISIWISHSIQTGNQNHTGICNQGSITYKVVAGQDSTSVILTGNSSLCPIRGWAIHSKDNGIRIGSKGDVFVIREPFISCSHLECRTFFLTQGALLNDKHSRGTFKDRSPYRALMSCPVGEAPSPYNSRFESVAWSASACHDGMGWLTIGISGPDDGAVAVLKYNGIITETIKSWRKNILRTQESECTCVNGSCFTIMTDGPSDGLASYKIFKIEKGKVTKSIELNAPNSHYEECSCYPDTGKVMCVCRDNWHGSNRPWVSFDQNLDYKIGYICSGVFGDNPRPKDGTGSCGPVSADGANGVKGFSYKYGNGVWIGRTKSDSSRHGFEMIWDPNGWTETDSRFSMRQDVVAMTDRSGYSGSFVQHPELTGLDCMRPCFWVELIRGLPEEDAIWTSGSIISFCGVNSDTVDWSWPDGAELPFTIDK

SEQ ID NO: 15071 - protein, 449 aa, Artificial Sequence
  neuraminidase__InfluenzaA__ABF56651
MNPNQKIITIGSICMVTGIVSLMLQVGNMISIWVSHSIHTGSQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15072 - protein, 469 aa, Artificial Sequence; identical to SEQ ID NO: 14827
  neuraminidase__InfluenzaA__ABF82654

SEQ ID NO: 15073 - protein, 470 aa, Artificial Sequence; identical to SEQ ID NO: 14396
  neuraminidase__InfluenzaA__ABF82665

SEQ ID NO: 15074 - protein, 470 aa, Artificial Sequence; identical to SEQ ID NO: 14396
  neuraminidase__InfluenzaA__ABF82676

SEQ ID NO: 15075 - protein, 470 aa, Artificial Sequence
  neuraminidase__InfluenzaA__ABF82687
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKTTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLNCIRPCFWVELVRGLPKENTTIWTSGSSISFCGVNSDTANWSWPDGAELPFTIDK

SEQ ID NO: 15076 - protein, 469 aa, Artificial Sequence
  neuraminidase__InfluenzaA__ABF82698
MNPNQKIITIGSVSLTITTICFLMQIAILVITVTLHFKQCECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLDPNNEEGGHGVKGWAFDDGNDVWMGRTISEKLRSGYETFKVIGGWSKPNSKLQINRQVIVDKGNRSGYSGIFSVEGKSCTNRCFYVELIRGRKQETEVWWTSNSIVVFCGTSGTYGTGSWPDGADINLMPI

SEQ ID NO: 15077 - protein, 469 aa, Artificial Sequence; identical to SEQ ID NO: 14126
  neuraminidase__InfluenzaA__ABF82709

SEQ ID NO: 15078 - protein, 470 aa, Artificial Sequence; identical to SEQ ID NO: 14415
  neuraminidase__InfluenzaA__ABF82822

SEQ ID NO: 15079 - protein, 470 aa, Artificial Sequence; identical to SEQ ID NO: 14396
  neuraminidase__InfluenzaA__ABF82833

SEQ ID NO: 15080 - protein, 470 aa, Artificial Sequence; identical to SEQ ID NO: 14396
  neuraminidase__InfluenzaA__ABF82844

SEQ ID NO: 15081 - protein, 470 aa, Artificial Sequence
  neuraminidase__InfluenzaA__ABF82855
MNPNQKIITIGSISIAIGIISLMLQIGNIISIWASHSIQIGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 15082 - protein, 470 aa, Artificial Sequence; identical to SEQ ID NO: 14396
  neuraminidase__InfluenzaA__ABF82866

SEQ ID NO: 15083 - protein, 470 aa, Artificial Sequence; identical to SEQ ID NO: 14930
  neuraminidase__InfluenzaA__ABF82888

SEQ ID NO: 15084 - protein, 470 aa, Artificial Sequence; identical to SEQ ID NO: 14396
  neuraminidase__InfluenzaA__ABF82910

SEQ ID NO: 15085 - protein, 470 aa, Artificial Sequence; identical to SEQ ID NO: 14396
  neuraminidase__InfluenzaA__ABF82921

SEQ ID NO: 15086 - protein, 470 aa, Artificial Sequence; identical to SEQ ID NO: 14396
  neuraminidase__InfluenzaA__ABF82932

SEQ ID NO: 15087 - protein, 470 aa, Artificial Sequence; identical to SEQ ID NO: 14396
  neuraminidase__InfluenzaA__ABF82943

SEQ ID NO: 15088 - protein, 449 aa, Artificial Sequence
  neuraminidase__InfluenzaA__ABG20474
MNPNQKIITIGSICMVIGIVSLMLQIGNMISIWVSHSIQTGNQRQAEPISNTKFLTEKAVASVTLAGNSSLCPISGWAVYSKDNSIRIGSRGDVFVIREPFISCSHLECRTFFLTQGALLNDKHSNGTVKDRSPYRTLMSCPVGEAPSPYNSRFESVAWSASACHDGTSWLTIGISGPDNGAVAVLKYNGIITDTIKSWRNNVLRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSNFSVKQDIVAITDWSGYSGSFVQHPELTGLDCIRPCFWVELIRGRPKESTIWTSGSSIFFCGVNSDTVSWSWPDGAELPFTIDK

SEQ ID NO: 15089 - protein, 469 aa, Artificial Sequence; identical to SEQ ID NO: 14126
  neuraminidase__InfluenzaA__ABG26761

SEQ ID NO: 15090 - protein, 469 aa, Artificial Sequence
  neuraminidase__InfluenzaA__ABG26772
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIKEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15091 - protein, 470 aa, Artificial Sequence
  neuraminidase__InfluenzaA__ABG26783
MNPNQKIITIGSISIAIGIISLILQIGNIISIWASHSIQTGSQNHTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGRVTKSIELDAPNYHYEECSCYPNTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDIVAMTDWSGYSGSFVQHPELTGLDCIRPCFWVELVRGLPRENTTIWTSGSSISFCGVNSDTANWSWPDGAELPFTIDK

SEQ ID NO: 15092 - protein, 470 aa, Artificial Sequence; identical to SEQ ID NO: 14968
  neuraminidase__InfluenzaA__ABG26794

SEQ ID NO: 15093 - protein, 469 aa, Artificial Sequence
  neuraminidase__InfluenzaA__ABG26805
MNPNQKIITIGSVSLTIATICFLTQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLNNKHSNDTIHDRTPYRTLLMNELGVPFHLGTKQVCIAWSSSSCHDGKAWLHVCITGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGNHGVKGWAFDDGNDVWMGRTIGEELRSGYETFKVIGGWSTPNSKLQINRQIIVDSGNRSGYSGIFSVEGKSCINRCFYVELIRGREQETRVWWTSNSIVVFCGTSGTYGTGSWPDGADINLMPI

SEQ ID NO: 15094 - protein, 470 aa, Artificial Sequence; identical to SEQ ID NO: 14951
  neuraminidase__InfluenzaA__ABG26816

SEQ ID NO: 15095 - protein, 470 aa, Artificial Sequence; identical to SEQ ID NO: 15059
  neuraminidase__InfluenzaA__ABG26827

SEQ ID NO: 15096 - protein, 470 aa, Artificial Sequence; identical to SEQ ID NO: 15059
  neuraminidase__InfluenzaA__ABG26838

SEQ ID NO: 15097 - protein, 469 aa, Artificial Sequence
  neuraminidase__InfluenzaA__ABG26860
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASDRADTKILFIEEGKIVHISPLSGSAQHVEECSCYPRYPGVRCVCRDNWKGSNRPIIDINVKDYSIVSSYVCSGLVGDTPRKNDSSSSSYCWNPNNEKGGHGVKGWAFDDGNDVWMGRTISEESRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15098 - protein, 469 aa, Artificial Sequence
  neuraminidase__InfluenzaA__ABG26871
MNPNQKIITIGSVSLTIATICFLMQIAILVTTVTLHFKQYECNSPPYNQIMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASDRADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEESRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15099 - protein, 469 aa, Artificial Sequence
  neuraminidase__InfluenzaA__ABG26893
MNPNQKIITIGSISLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASDRADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEESRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15100 - protein, 469 aa, Artificial Sequence
  neuraminidase__InfluenzaA__ABG26915
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSISSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCVNRCFYVELIRGRKQETEVWWTSNSIVVFCGTSGTYGTGSWPDGADINLMPI

SEQ ID NO: 15101 - protein, 469 aa, Artificial Sequence
  neuraminidase__InfluenzaA__ABG26937
MNPNQKIITIGSVSLTIATICFLMQIAILVTTVTLHFKQYECNSPPSNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15102 - protein, 470 aa, Artificial Sequence; identical to SEQ ID NO: 14396
  neuraminidase__InfluenzaA__ABG26948

SEQ ID NO: 15103 - protein, 469 aa, Artificial Sequence; identical to SEQ ID NO: 14166
  neuraminidase__InfluenzaA__ABG26959

SEQ ID NO: 15104 - protein, 470 aa, Artificial Sequence
  neuraminidase__InfluenzaA__ABG37123
MNPNQKIITIGSISITIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 15105 - protein, 469 aa, Artificial Sequence
  neuraminidase__InfluenzaA__ABG37134
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISQLLGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15106 - protein, 469 aa, Artificial Sequence; identical to SEQ ID NO: 14126
  neuraminidase__InfluenzaA__ABG37145

SEQ ID NO: 15107 - protein, 469 aa, Artificial Sequence
  neuraminidase__InfluenzaA__ABG37156
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSNYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15108 - protein, 469 aa, Artificial Sequence
  neuraminidase__InfluenzaA__ABG37167
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSISSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCVNRCFYVELIRGRKQETEVWWTSNSIVVFCGTSGTYGTGSWPDGADINLMPI

SEQ ID NO: 15109 - protein, 469 aa, Artificial Sequence
  neuraminidase__InfluenzaA__ABG37189
MNPNQKIITIGSVSLTIATICFLMQIAILVTTVTLHFKQYECNSPPNNQVLLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISSLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15110 - protein, 469 aa, Artificial Sequence
  neuraminidase__InfluenzaA__ABG37200
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDSGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISTLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15111 - protein, 469 aa, Artificial Sequence
  neuraminidase__InfluenzaA__ABG37211
MNPNQKIITIGSVSLTIATICFLTQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLNNKHSNDTIHDRTPYRTLLMNELGVPFHLGTKQVCIAWSSSSCHDGKAWLHVCITGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGNHGVKGWAFDDGNDVWMGRTIGEELRSGYETFKVIGGWSTPNSKLQINRQVIVDSGNRSGYSGIFSVEGKSCINRCFYVELIRGREQETRVWWTSNSIVVFCGTSGTYGTGSWPDGADINLMPI

SEQ ID NO: 15112 - protein, 469 aa, Artificial Sequence
  neuraminidase__InfluenzaA__ABG37233
MNPNQKIITIGSVSLTIATICFLMQIAILVTTVTLHFKQYECNSPPSNQAMLCEPTIIERNITEIVYLTNTTIEKEICPKLAEYRNWSKPQCKITGFAPFSKDNSIRLSAGGDIWVTREPYVSCDPGKCYQFALGQGTTINNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSNSYCRNPNNEKGSHGVKGWAFDDGNDVWMGRTISAESRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15113 - protein, 469 aa, Artificial Sequence
  neuraminidase__InfluenzaA__ABG37244
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASDRADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEESRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15114 - protein, 469 aa, Artificial Sequence; identical to SEQ ID NO: 15113
  neuraminidase__InfluenzaA__ABG37255

SEQ ID NO: 15115 - protein, 469 aa, Artificial Sequence; identical to SEQ ID NO: 15100
  neuraminidase__InfluenzaA__ABG37266

SEQ ID NO: 15116 - protein, 469 aa, Artificial Sequence; identical to SEQ ID NO: 15113
  neuraminidase__InfluenzaA__ABG37277

SEQ ID NO: 15117 - protein, 469 aa, Artificial Sequence; identical to SEQ ID NO: 15113
  neuraminidase__InfluenzaA__ABG37288

SEQ ID NO: 15118 - protein, 469 aa, Artificial Sequence; identical to SEQ ID NO: 15113
  neuraminidase__InfluenzaA__ABG37310

SEQ ID NO: 15119 - protein, 469 aa, Artificial Sequence; identical to SEQ ID NO: 15100
  neuraminidase__InfluenzaA__ABG37321

SEQ ID NO: 15120 - protein, 469 aa, Artificial Sequence
  neuraminidase__InfluenzaA__ABG37332
MNPNQKIITIGSVSLTIATICFLMQIAILVTTVTLHFKQHECNSPPNNQVMLCEPTIIERNITEIVHLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASDRADTKILFIEEGKIVHISPLSGGAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEESRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15121 - protein, 469 aa, Artificial Sequence
  neuraminidase__InfluenzaA__ABG37343
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASDRADTKILFIEEGKIVHISPLSGSAQHVEECSCYPRYPGVRCVCRDNWKGSNRPIVDINVKNYSIVSSYVCSGLVGDTPRKNDSSSSSYCWNPNNEKGGHGVKGWAFDDGNDVWMGRTISEESRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15122 - protein, 469 aa, Artificial Sequence; identical to SEQ ID NO: 15101
  neuraminidase__InfluenzaA__ABG37354

SEQ ID NO: 15123 - protein, 470 aa, Artificial Sequence; identical to SEQ ID NO: 14828
  neuraminidase__InfluenzaA__ABG37365

SEQ ID NO: 15124 - protein, 470 aa, Artificial Sequence; identical to SEQ ID NO: 14930
  neuraminidase__InfluenzaA__ABG37387

SEQ ID NO: 15125 - protein, 470 aa, Artificial Sequence
  neuraminidase__InfluenzaA__ABG37398
MNPNQKIITIGSISIAIGIISLMLQIGNIISIWASHSIQTGSQNHTGVCNQRIITYENNTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 15126 - protein, 469 aa, Artificial Sequence
  neuraminidase__InfluenzaA__ABG37409
MNPNQKIITIGSVSLTIATICFLMQIVILVTTVTLHFKQYECNSPPNNQVMPCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDRNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15127 - protein, 469 aa, Artificial Sequence
  neuraminidase__InfluenzaA__ABG37442
MNPNQKIITIGSVSLTIATICFLMQIAILVTTVTLHFKQFECNSPPNNQVMLCEPTIIEGNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15128 - protein, 469 aa, Artificial Sequence; identical to SEQ ID NO: 14154
  neuraminidase__InfluenzaA__ABG37453

SEQ ID NO: 15129 - protein, 469 aa, Artificial Sequence; identical to SEQ ID NO: 14166
  neuraminidase__InfluenzaA__ABG37464

SEQ ID NO: 15130 - protein, 469 aa, Artificial Sequence
  neuraminidase__InfluenzaA__ABG37475
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGDRSGYSGIFSVEGKSCINRCFYVELIRGRKEETEVLWTSNSIVVFCGTSGTYGTGSWPDGADINLMPI

SEQ ID NO: 15131 - protein, 469 aa, Artificial Sequence
  neuraminidase__InfluenzaA__ABG37486
MNPNQKIITIGSVSLTIATICFLMQIAILVTTVTLHFKQYECNSPPNNQVMLCEPTIIERNITEIVYLTNTTIEKEICPKLAEYRNWSKPQCNLTGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15132 - protein, 469 aa, Artificial Sequence
  neuraminidase__InfluenzaA__ABG37497
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKIIFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15133 - protein, 469 aa, Artificial Sequence; identical to SEQ ID NO: 14180
  neuraminidase__InfluenzaA__ABG37508

SEQ ID NO: 15134 - protein, 469 aa, Artificial Sequence; identical to SEQ ID NO: 14591
  neuraminidase__InfluenzaA__ABG37519

SEQ ID NO: 15135 - protein, 469 aa, Artificial Sequence; identical to SEQ ID NO: 14591
  neuraminidase__InfluenzaA__ABG37530

SEQ ID NO: 15136 - protein, 469 aa, Artificial Sequence; identical to SEQ ID NO: 14591
  neuraminidase__InfluenzaA__ABG37541

SEQ ID NO: 15137 - protein, 469 aa, Artificial Sequence; identical to SEQ ID NO: 14591
  neuraminidase__InfluenzaA__ABG37552

SEQ ID NO: 15138 - protein, 469 aa, Artificial Sequence; identical to SEQ ID NO: 14591
  neuraminidase__InfluenzaA__ABG37563

SEQ ID NO: 15139 - protein, 469 aa, Artificial Sequence; identical to SEQ ID NO: 14591
  neuraminidase__InfluenzaA__ABG37585

SEQ ID NO: 15140 - protein, 469 aa, Artificial Sequence; identical to SEQ ID NO: 14591
  neuraminidase__InfluenzaA__ABG37596

SEQ ID NO: 15141 - protein, 469 aa, Artificial Sequence; identical to SEQ ID NO: 14591
  neuraminidase__InfluenzaA__ABG37607

SEQ ID NO: 15142 - protein, 469 aa, Artificial Sequence; identical to SEQ ID NO: 14591
  neuraminidase__InfluenzaA__ABG37618

SEQ ID NO: 15143 - protein, 470 aa, Artificial Sequence; identical to SEQ ID NO: 14828
  neuraminidase__InfluenzaA__ABG47810

SEQ ID NO: 15144 - protein, 470 aa, Artificial Sequence
  neuraminidase__InfluenzaA__ABG47832
MNPNQKIITIGSISIAIGIISLILQVGNIISIWASHSIQTGSQNHTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGRVTKSIELDAPNYHYEECSCYPNTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 15145 - protein, 470 aa, Artificial Sequence; identical to SEQ ID NO: 14968
  neuraminidase__InfluenzaA__ABG47843

SEQ ID NO: 15146 - protein, 469 aa, Artificial Sequence
  neuraminidase__InfluenzaA__ABG47865
MNPNQKIITIGSVSLTIATICFLMQIAILVITVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYSGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15147 - protein, 469 aa, Artificial Sequence; identical to SEQ ID NO: 15113
  neuraminidase__InfluenzaA__ABG47876

SEQ ID NO: 15148 - protein, 469 aa, Artificial Sequence; identical to SEQ ID NO: 15113
  neuraminidase__InfluenzaA__ABG47887

SEQ ID NO: 15149 - protein, 469 aa, Artificial Sequence; identical to SEQ ID NO: 15100
  neuraminidase__InfluenzaA__ABG47898

SEQ ID NO: 15150 - protein, 469 aa, Artificial Sequence; identical to SEQ ID NO: 15113
  neuraminidase__InfluenzaA__ABG47909

SEQ ID NO: 15151 - protein, 469 aa, Artificial Sequence; identical to SEQ ID NO: 15101
  neuraminidase__InfluenzaA__ABG47920

SEQ ID NO: 15152 - protein, 469 aa, Artificial Sequence; identical to SEQ ID NO: 15101
  neuraminidase__InfluenzaA__ABG47931

SEQ ID NO: 15153 - protein, 469 aa, Artificial Sequence; identical to SEQ ID NO: 15101
  neuraminidase__InfluenzaA__ABG47942

SEQ ID NO: 15154 - protein, 469 aa, Artificial Sequence
  neuraminidase__InfluenzaA__ABG47953
MNPNQKIITIGSVSLTIATICFLMQIAILVTTVTLHFKQYECNSPPSNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGANINLMPI

SEQ ID NO: 15155 - protein, 469 aa, Artificial Sequence
  neuraminidase__InfluenzaA__ABG47964
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCQNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15156 - protein, 469 aa, Artificial Sequence
  neuraminidase__InfluenzaA__ABG47975
MNPNQKIITIGSVSLTIATICFLMQIAILVTTVTLHFKQYECNSPPSNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRDPNNERGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15157 - protein, 469 aa, Artificial Sequence
  neuraminidase__InfluenzaA__ABG47986
MNPNQKIITIGSVSLTIATICFLMQIAILVTTVTLHFKQYECNSPPSNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRKPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15158 - protein, 469 aa, Artificial Sequence; identical to SEQ ID NO: 15101
  neuraminidase__InfluenzaA__ABG47997

SEQ ID NO: 15159 - protein, 469 aa, Artificial Sequence
  neuraminidase__InfluenzaA__ABG48008
MNPNQKIITIGSVSLTIATICFLMQIAILVTTVTLHFKQYECNSPPSNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRRNDSSSSSYCRKPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15160 - protein, 469 aa, Artificial Sequence
  neuraminidase__InfluenzaA__ABG48019
MNPNQKIITIGSVSLTIATICFLMQIAILVTTVTLHFKQYECNSPPSNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCACRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 15161 - protein, 469 aa, Artificial Sequence; identical to SEQ ID NO: 15101
  neuraminidase__InfluenzaA__ABG48030

SEQ ID NO: 15162 - protein, 469 aa, Artificial Sequence; identical to SEQ ID NO: 15101
  neuraminidase__InfluenzaA__ABG48041

SEQ ID NO: 15163 - protein, 470 aa, Artificial Sequence; identical to SEQ ID NO: 14828
  neuraminidase__InfluenzaA__ABG48052

SEQ ID NO: 15164 - protein, 469 aa, Artificial Sequence; identical to SEQ ID NO: 14730
  neuraminidase__InfluenzaA__ABG48063

SEQ ID NO: 15165 - protein, 469 aa, Artificial Sequence; identical to SEQ ID NO: 14853
  neuraminidase__InfluenzaA__ABG48074

SEQ ID NO: 15166 - protein, 469 aa, Artificial Sequence; identical to SEQ ID NO: 14154
  neuraminidase__InfluenzaA__ABG48085

SEQ ID NO: 15167 - protein, 469 aa, Artificial Sequence
  neuraminidase__InfluenzaA__ABG48107
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKTLRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15168 - protein, 469 aa, Artificial Sequence; identical to SEQ ID NO: 14166
  neuraminidase__InfluenzaA__ABG48118

SEQ ID NO: 15169 - protein, 469 aa, Artificial Sequence; identical to SEQ ID NO: 14166
  neuraminidase__InfluenzaA__ABG48129

SEQ ID NO: 15170 - protein, 469 aa, Artificial Sequence; identical to SEQ ID NO: 14154
  neuraminidase__InfluenzaA__ABG48140

SEQ ID NO: 15171 - protein, 469 aa, Artificial Sequence; identical to SEQ ID NO: 14166
  neuraminidase__InfluenzaA__ABG48151

SEQ ID NO: 15172 - protein, 469 aa, Artificial Sequence; identical to SEQ ID NO: 14154
  neuraminidase__InfluenzaA__ABG48173

SEQ ID NO: 15173 - protein, 469 aa, Artificial Sequence; identical to SEQ ID NO: 14166
  neuraminidase__InfluenzaA__ABG48184

SEQ ID NO: 15174 - protein, 469 aa, Artificial Sequence
  neuraminidase__InfluenzaA__ABG48195
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCIDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15175 - protein, 469 aa, Artificial Sequence
  neuraminidase__InfluenzaA__ABG48206
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTINEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15176 - protein, 469 aa, Artificial Sequence; identical to SEQ ID NO: 14591
  neuraminidase__InfluenzaA__ABG48217

SEQ ID NO: 15177 - protein, 469 aa, Artificial Sequence; identical to SEQ ID NO: 14591
  neuraminidase__InfluenzaA__ABG48228

SEQ ID NO: 15178 - protein, 469 aa, Artificial Sequence; identical to SEQ ID NO: 15175
  neuraminidase__InfluenzaA__ABG48239

SEQ ID NO: 15179 - protein, 469 aa, Artificial Sequence; identical to SEQ ID NO: 14591
  neuraminidase__InfluenzaA__ABG48250

SEQ ID NO: 15180 - protein, 469 aa, Artificial Sequence
  neuraminidase__InfluenzaA__ABG48272
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15181 - protein, 469 aa, Artificial Sequence
  neuraminidase__InfluenzaA__ABG48294
MNPNQKIITIGSVSLTIATICFLMQIAILVTTVTLHFKQYECSSPPNNQVIPCQPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSRNILRTQESECVCINGTCTVVMTDGSASERADTKILFIEEGKVVHISPLSGSAQHVEECSCYPRYPGVRCVCRDNWKGSNRPIVDINVKDYSIISSYVCSGLVGDTPRRNDSSSSSYCQNPNNEKGSHGVKGWAFDDGNDVWMGRTISEELRSGYETFKVIGGWSTPNSKLQINRQVIVDSGNRSGYSGIFSVEGKSCINRCFYVELIRGRKQETKVWWTSNSIVVFCGTSGTYGTGSWPDGADIDLMPI

SEQ ID NO: 15182 - protein, 469 aa, Artificial Sequence
  neuraminidase__InfluenzaA__ABG48305
MNPNQKIIIIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15183 - protein, 469 aa, Artificial Sequence
  neuraminidase__InfluenzaA__ABG48316
MNPNQKIITIGSVSLTVATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVERGNRSGYSGIFSVEGKSCINRCFYVELIRGRKQETEVWWTSNSIVVFCGTSGTYGTGSWPDGADINLMPI

SEQ ID NO: 15184 - protein, 469 aa, Artificial Sequence
  neuraminidase__InfluenzaA__ABG48327
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSRGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15185 - protein, 469 aa, Artificial Sequence
  neuraminidase__InfluenzaA__ABG48338
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15186 - protein, 469 aa, Artificial Sequence; identical to SEQ ID NO: 15185
  neuraminidase__InfluenzaA__ABG48349

SEQ ID NO: 15187 - protein, 469 aa, Artificial Sequence
  neuraminidase__InfluenzaA__ABG48360
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMSELGVPFHLGTKQVCIAWSSSSCHDGKAWLHVCVTGHDENATASFIYDGKLVDSIGSWSKNILRTQESECVCINGTCTVVMTDGSASERADTKILFIEEGKIVHISPLSGSAQHVEECSCYPRYPGVRCVCRDNWKGSNRPIVDINVKDHSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15188 - protein, 469 aa, Artificial Sequence; identical to SEQ ID NO: 15185
  neuraminidase__InfluenzaA__ABG48371

SEQ ID NO: 15189 - protein, 469 aa, Artificial Sequence
  neuraminidase__InfluenzaA__ABG67138
MNPNQKIITIGSVSLTIATICFLTQIAILVTTVTLHFKQYECNSPPSNQVMLCEPTTIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15190 - protein, 469 aa, Artificial Sequence; identical to SEQ ID NO: 14126
  neuraminidase__InfluenzaA__ABG67149

SEQ ID NO: 15191 - protein, 469 aa, Artificial Sequence
  neuraminidase__InfluenzaA__ABG67160
MNPNQKIITIGSVSLTIATICFLMQIAILVTTVTLHFKQYECNSPPNNQVMLCEPTIIERNITEIVYLTNTTIEKEICPKLAEYRSWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCVNGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15192 - protein, 469 aa, Artificial Sequence
  neuraminidase__InfluenzaA__ABG67171
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASDRADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEESRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15193 - protein, 469 aa, Artificial Sequence; identical to SEQ ID NO: 15113
  neuraminidase__InfluenzaA__ABG67182

SEQ ID NO: 15194 - protein, 469 aa, Artificial Sequence
  neuraminidase__InfluenzaA__ABG67193
MNPNQKIITIGSVSLTIATICFLMQIAILVTTVTLHFKQYECNSPPNNQVMLCEPTTIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASDRADTKILFIEEGKIVHISPLSGSAQHVEECSCYPRYPGVRCVCRDNWKGSNRPIVDINVKNYSIVSSYVCSGLVGDTPRKNDSSSSSYCWNPNNEKGGHGVKGWAFDDGNDVWMGRTISEESRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15195 - protein, 469 aa, Artificial Sequence; identical to SEQ ID NO: 15113
  neuraminidase__InfluenzaA__ABG67204

SEQ ID NO: 15196 - protein, 469 aa, Artificial Sequence
  neuraminidase__InfluenzaA__ABG67215
MNPNQKIITIGSVSLTIATICFLMQIAILVTTVTLHFKQYECNSPPSNQVMLCEPTIIERNITEIVYLTNTTIEKEICPKLAEYRNWSKPQCKITGFAPFSKDNSIRLSAGGDIWVTREPYVSCGPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15197 - protein, 469 aa, Artificial Sequence; identical to SEQ ID NO: 15101
  neuraminidase__InfluenzaA__ABG67226

SEQ ID NO: 15198 - protein, 469 aa, Artificial Sequence; identical to SEQ ID NO: 15101
  neuraminidase__InfluenzaA__ABG67248

SEQ ID NO: 15199 - protein, 470 aa, Artificial Sequence; identical to SEQ ID NO: 14828
  neuraminidase__InfluenzaA__ABG67480

SEQ ID NO: 15200 - protein, 470 aa, Artificial Sequence; identical to SEQ ID NO: 14396
  neuraminidase__InfluenzaA__ABG67494

SEQ ID NO: 15201 - protein, 469 aa, Artificial Sequence; identical to SEQ ID NO: 14154
  neuraminidase__InfluenzaA__ABG67505

SEQ ID NO: 15202 - protein, 469 aa, Artificial Sequence; identical to SEQ ID NO: 14154
  neuraminidase__InfluenzaA__ABG67516

SEQ ID NO: 15203 - protein, 469 aa, Artificial Sequence; identical to SEQ ID NO: 15167
  neuraminidase__InfluenzaA__ABG67527

SEQ ID NO: 15204 - protein, 469 aa, Artificial Sequence
  neuraminidase__InfluenzaA__ABG67538
MNPNQKIITIGSVSLTIATICFLMQIAILVTTVTLHFKQYECNSPPNNQVMLCEPTTIERNTTEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIIDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15205 - protein, 469 aa, Artificial Sequence
  neuraminidase__InfluenzaA__ABG67549
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEENEVWWTSNSIVVFCGTSGTYGTGSWPDGADINLMPI

SEQ ID NO: 15206 - protein, 469 aa, Artificial Sequence; identical to SEQ ID NO: 14591
  neuraminidase__InfluenzaA__ABG67560

SEQ ID NO: 15207 - protein, 469 aa, Artificial Sequence; identical to SEQ ID NO: 14591
  neuraminidase__InfluenzaA__ABG67571

SEQ ID NO: 15208 - protein, 469 aa, Artificial Sequence
  neuraminidase__InfluenzaA__ABG67582
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAKHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15209 - protein, 469 aa, Artificial Sequence; identical to SEQ ID NO: 15175
  neuraminidase__InfluenzaA__ABG67593

SEQ ID NO: 15210 - protein, 469 aa, Artificial Sequence; identical to SEQ ID NO: 14591
  neuraminidase__InfluenzaA__ABG67604

SEQ ID NO: 15211 - protein, 469 aa, Artificial Sequence; identical to SEQ ID NO: 14591
  neuraminidase__InfluenzaA__ABG67615

SEQ ID NO: 15212 - protein, 469 aa, Artificial Sequence; identical to SEQ ID NO: 14591
  neuraminidase__InfluenzaA__ABG67626

SEQ ID NO: 15213 - protein, 469 aa, Artificial Sequence; identical to SEQ ID NO: 14591
  neuraminidase__InfluenzaA__ABG67637

SEQ ID NO: 15214 - protein, 469 aa, Artificial Sequence; identical to SEQ ID NO: 14591
  neuraminidase__InfluenzaA__ABG67648

SEQ ID NO: 15215 - protein, 469 aa, Artificial Sequence
  neuraminidase__InfluenzaA__ABG67659
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSRDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15216 - protein, 469 aa, Artificial Sequence
  neuraminidase__InfluenzaA__ABG67670
MNPNQKIITIGSVSLTIATICFLMQIAILITTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15217 - protein, 469 aa, Artificial Sequence; identical to SEQ ID NO: 14730
  neuraminidase__InfluenzaA__ABG79944

SEQ ID NO: 15218 - protein, 470 aa, Artificial Sequence; identical to SEQ ID NO: 15059
  neuraminidase__InfluenzaA__ABG79955

SEQ ID NO: 15219 - protein, 469 aa, Artificial Sequence
  neuraminidase__InfluenzaA__ABG79966
MNPNQKIITIGSVSLTIATICFLMQIAILVTTVTLHFKQYECNSPPSNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCQNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15220 - protein, 469 aa, Artificial Sequence
  neuraminidase__InfluenzaA__ABG79977
MNPNQKIITIGSVSLTIATICFLMQIAILVTTVTLHFKQYECNSPPNNQAMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASDRADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEESRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15221 - protein, 469 aa, Artificial Sequence; identical to SEQ ID NO: 15113
  neuraminidase__InfluenzaA__ABG79988

SEQ ID NO: 15222 - protein, 469 aa, Artificial Sequence; identical to SEQ ID NO: 15113
  neuraminidase__InfluenzaA__ABG79999

SEQ ID NO: 15223 - protein, 469 aa, Artificial Sequence
  neuraminidase__InfluenzaA__ABG80010
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGKGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASDRADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEESRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15224 - protein, 469 aa, Artificial Sequence; identical to SEQ ID NO: 15113
  neuraminidase__InfluenzaA__ABG80021

SEQ ID NO: 15225 - protein, 469 aa, Artificial Sequence
  neuraminidase__InfluenzaA__ABG80032
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASIIYDGRLVDSISSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCVNRCFYVELIRGRKQETEVWWTSNSIVVFCGTSGTYGTGSWPDGADINLMPI

SEQ ID NO: 15226 - protein, 469 aa, Artificial Sequence; identical to SEQ ID NO: 15100
  neuraminidase__InfluenzaA__ABG80043

SEQ ID NO: 15227 - protein, 469 aa, Artificial Sequence; identical to SEQ ID NO: 15113
  neuraminidase__InfluenzaA__ABG80054

SEQ ID NO: 15228 - protein, 469 aa, Artificial Sequence; identical to SEQ ID NO: 15100
  neuraminidase__InfluenzaA__ABG80065

SEQ ID NO: 15229 - protein, 469 aa, Artificial Sequence
  neuraminidase__InfluenzaA__ABG80076
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKNCINRCFYVELIRGRKQETEVWWTSNSIVVFCGTSGTYGTGSWPDGADINLMPI

SEQ ID NO: 15230 - protein, 469 aa, Artificial Sequence
  neuraminidase__InfluenzaA__ABG80087
MNPNQKIITIGSVSLTIATICFLMQIAVLVTTVTLHFKQYECNSPPSNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCMAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15231 - protein, 469 aa, Artificial Sequence; identical to SEQ ID NO: 15157
  neuraminidase__InfluenzaA__ABG80098

SEQ ID NO: 15232 - protein, 469 aa, Artificial Sequence; identical to SEQ ID NO: 15101
  neuraminidase__InfluenzaA__ABG80109

SEQ ID NO: 15233 - protein, 469 aa, Artificial Sequence
  neuraminidase__InfluenzaA__ABG80120
MNPNQKIITIGSVSLTIATICFLMQIAILVTTVTLHFKQYECNSPPSNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECICINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15234 - protein, 469 aa, Artificial Sequence
  neuraminidase__InfluenzaA__ABG80131
MNPNQKIITIGSVSLTIATICFLMQIAIMVTTVTLHFKQYECNSPPSNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15235 - protein, 469 aa, Artificial Sequence; identical to SEQ ID NO: 15101
  neuraminidase__InfluenzaA__ABG80142

SEQ ID NO: 15236 - protein, 469 aa, Artificial Sequence; identical to SEQ ID NO: 15157
  neuraminidase__InfluenzaA__ABG80153

SEQ ID NO: 15237 - protein, 469 aa, Artificial Sequence; identical to SEQ ID NO: 15101
  neuraminidase__InfluenzaA__ABG80164

SEQ ID NO: 15238 - protein, 470 aa, Artificial Sequence; identical to SEQ ID NO: 14828
  neuraminidase__InfluenzaA__ABG80186

SEQ ID NO: 15239 - protein, 469 aa, Artificial Sequence; identical to SEQ ID NO: 14061
  neuraminidase__InfluenzaA__ABG80197

SEQ ID NO: 15240 - protein, 469 aa, Artificial Sequence; identical to SEQ ID NO: 14253
  neuraminidase__InfluenzaA__ABG80219

SEQ ID NO: 15241 - protein, 469 aa, Artificial Sequence
  neuraminidase__InfluenzaA__ABG80230
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKNILRTQESECVCINGTCTVVMTDGSASGKADTKILFIEEGKIVHISTLSESAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15242 - protein, 469 aa, Artificial Sequence; identical to SEQ ID NO: 14591
  neuraminidase__InfluenzaA__ABG80241

SEQ ID NO: 15243 - protein, 469 aa, Artificial Sequence; identical to SEQ ID NO: 14591
  neuraminidase__InfluenzaA__ABG80252

SEQ ID NO: 15244 - protein, 469 aa, Artificial Sequence; identical to SEQ ID NO: 15175
  neuraminidase__InfluenzaA__ABG80263

SEQ ID NO: 15245 - protein, 469 aa, Artificial Sequence; identical to SEQ ID NO: 14736
  neuraminidase__InfluenzaA__ABG80274

SEQ ID NO: 15246 - protein, 469 aa, Artificial Sequence; identical to SEQ ID NO: 14327
  neuraminidase__InfluenzaA__ABG80285

SEQ ID NO: 15247 - protein, 469 aa, Artificial Sequence; identical to SEQ ID NO: 14327
  neuraminidase__InfluenzaA__ABG80296

SEQ ID NO: 15248 - protein, 469 aa, Artificial Sequence; identical to SEQ ID NO: 14327
  neuraminidase__InfluenzaA__ABG80307

SEQ ID NO: 15249 - protein, 469 aa, Artificial Sequence; identical to SEQ ID NO: 14714
  neuraminidase__InfluenzaA__ABG80318

SEQ ID NO: 15250 - protein, 469 aa, Artificial Sequence; identical to SEQ ID NO: 14327
  neuraminidase__InfluenzaA__ABG80329

SEQ ID NO: 15251 - protein, 469 aa, Artificial Sequence; identical to SEQ ID NO: 14327
  neuraminidase__InfluenzaA__ABG80340

SEQ ID NO: 15252 - protein, 469 aa, Artificial Sequence; identical to SEQ ID NO: 15185
  neuraminidase__InfluenzaA__ABG80351

SEQ ID NO: 15253 - protein, 469 aa, Artificial Sequence
  neuraminidase__InfluenzaA__ABG80373
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDHSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15254 - protein, 469 aa, Artificial Sequence; identical to SEQ ID NO: 15253
  neuraminidase__InfluenzaA__ABG80384

SEQ ID NO: 15255 - protein, 469 aa, Artificial Sequence
  neuraminidase__InfluenzaA__ABG80395
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASKRADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNMSGYSGIFSVEGKSCINRCFYVELIRGRKQETEVWWTSNSIVVFCGTSGTYGTGSWPDGADINLMPI

SEQ ID NO: 15256 - protein, 469 aa, Artificial Sequence; identical to SEQ ID NO: 15185
  neuraminidase__InfluenzaA__ABG80406

SEQ ID NO: 15257 - protein, 469 aa, Artificial Sequence; identical to SEQ ID NO: 15185
  neuraminidase__InfluenzaA__ABG80417

SEQ ID NO: 15258 - protein, 469 aa, Artificial Sequence; identical to SEQ ID NO: 15185
  neuraminidase__InfluenzaA__ABG80428

SEQ ID NO: 15259 - protein, 469 aa, Artificial Sequence; identical to SEQ ID NO: 14126
  neuraminidase__InfluenzaA__ABG88292

SEQ ID NO: 15260 - protein, 470 aa, Artificial Sequence; identical to SEQ ID NO: 15050
  neuraminidase__InfluenzaA__ABG88314

SEQ ID NO: 15261 - protein, 470 aa, Artificial Sequence
  neuraminidase__InfluenzaA__ABG88325
MNPNQKIITIGSTSIAIGIISLILQIGNIISIWASHSIQTGSQNHTGICNQRIITYENSTWVNQTYVNINNTSVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGRVTKSIELDAPNYHYEECSCYPDTGTVMCVCRDNWHGSNRPWVSFNQNLDYQTGYICSGVFGDNPRPKDGEGSCNPVTADGADGVKGFSYRYGNGVWIGRTKSNRLRKGFEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 15262 - protein, 470 aa, Artificial Sequence
  neuraminidase__InfluenzaA__ABG88336
MNPNQKIITIGSICMAIGIISLILQIGNIISIWVSHSIQTGNQNHTGICNQRIITYENSTWVNQTYVNINNTNVVAGKDTTSVTLAGNSSLCPVRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSNGPASYKIFKIEKGKITKSIELDAPNSHYEECSCYPDTGTVMCVCRDNWHGSNRPWVSFNQNLDYQLGYICSGIFGDNPRPKDGKGSCGPVTVDGADGVKGFSYRYGNGVWIGRTKSNSSRKGFEMIWDPNGWTDTDSNFLVKQDVVAMTDWSGYSGSFVQHPELTGLDCMRPCFWVELIRGRPRETTTIWTSGSSISFCGVNSDTVNWSWPDGAELPFTIDK

SEQ ID NO: 15263 - protein, 470 aa, Artificial Sequence
  neuraminidase__InfluenzaA__ABG88347
MNPNQKIITIGSICMAIGIIGLILQIGNIISIWVSHSIQTGSQNHTGICNQRIITYENSTWVNQTYVNINNTNVVAGKDTTSVTLAGNSSLCPVRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSNGPASYKIFKIEKGKITKSIELDAPNSHYEECSCYPDTGTVMCVCRDNWHGSNRPWVSFNQNLDYQLGYICSGIFGDNPRPKDGKGSCGPVTVDGADGVKGFSYRYGNGVWIGRTKSNSSRKGFEMIWDPNGWTDTDSNFLVKQDVVAMTDWSGYSGSFVQHPELTGLDCMRPCFWVELIRGRPRETTTIWTSGSSISFCGVNSDTVNWSWPDGAELPFTIDK

SEQ ID NO: 15264 - protein, 469 aa, Artificial Sequence
  neuraminidase__InfluenzaA__ABG88358
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASDRADTKILFIEEGKIVHIRPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEESRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15265 - protein, 469 aa, Artificial Sequence; identical to SEQ ID NO: 15113
  neuraminidase__InfluenzaA__ABG88369

SEQ ID NO: 15266 - protein, 469 aa, Artificial Sequence; identical to SEQ ID NO: 15113
  neuraminidase__InfluenzaA__ABG88380

SEQ ID NO: 15267 - protein, 469 aa, Artificial Sequence; identical to SEQ ID NO: 15113
  neuraminidase__InfluenzaA__ABG88391

SEQ ID NO: 15268 - protein, 469 aa, Artificial Sequence; identical to SEQ ID NO: 15100
  neuraminidase__InfluenzaA__ABG88402

SEQ ID NO: 15269 - protein, 469 aa, Artificial Sequence; identical to SEQ ID NO: 15157
  neuraminidase__InfluenzaA__ABG88413

SEQ ID NO: 15270 - protein, 469 aa, Artificial Sequence; identical to SEQ ID NO: 15101
  neuraminidase__InfluenzaA__ABG88424

SEQ ID NO: 15271 - protein, 469 aa, Artificial Sequence; identical to SEQ ID NO: 15101
  neuraminidase__InfluenzaA__ABG88435

SEQ ID NO: 15272 - protein, 469 aa, Artificial Sequence; identical to SEQ ID NO: 15101
  neuraminidase__InfluenzaA__ABG88446

SEQ ID NO: 15273 - protein, 469 aa, Artificial Sequence
  neuraminidase__InfluenzaA__ABG88457
MNPNQKIITIGSVSLTTATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIKEGKIVHISPLSGSAQHVEECSCYPRYPGVRCVCRDNWKGSNRPIVDINVKDYSIVSSYVCSGLVGDTPRKNDSSSSSYCQNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15274 - protein, 469 aa, Artificial Sequence; identical to SEQ ID NO: 15101
  neuraminidase__InfluenzaA__ABG88468

SEQ ID NO: 15275 - protein, 469 aa, Artificial Sequence; identical to SEQ ID NO: 15101
  neuraminidase__InfluenzaA__ABG88479

SEQ ID NO: 15276 - protein, 469 aa, Artificial Sequence; identical to SEQ ID NO: 15101
  neuraminidase__InfluenzaA__ABG88490

SEQ ID NO: 15277 - protein, 469 aa, Artificial Sequence; identical to SEQ ID NO: 15101
  neuraminidase__InfluenzaA__ABG88501

SEQ ID NO: 15278 - protein, 469 aa, Artificial Sequence; identical to SEQ ID NO: 15101
  neuraminidase__InfluenzaA__ABG88512

SEQ ID NO: 15279 - protein, 469 aa, Artificial Sequence; identical to SEQ ID NO: 15101
  neuraminidase__InfluenzaA__ABG88523

SEQ ID NO: 15280 - protein, 469 aa, Artificial Sequence
  neuraminidase__InfluenzaA__ABG88534
MNPNQKIITIGSVSLTIATICFLMQIAILVTTVTLHFKQYECNSPPSNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVENKSCINRCFYVELIRGRKQETEVWWTSNSIVVFCGTSGTYGTGSWPDGADINLMPI

SEQ ID NO: 15281 - protein, 469 aa, Artificial Sequence; identical to SEQ ID NO: 14793
  neuraminidase__InfluenzaA__ABG88567

SEQ ID NO: 15282 - protein, 469 aa, Artificial Sequence
  neuraminidase__InfluenzaA__ABG88600
MNPNQKIITIGSVSLTIATICFLMQIAILVTTVTLHFKQYECNSPPNNQVMLCEPTIIERNITEIVYLTNTTIEKEICPKPAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15283 - protein, 469 aa, Artificial Sequence; identical to SEQ ID NO: 14154
  neuraminidase__InfluenzaA__ABG88611

SEQ ID NO: 15284 - protein, 469 aa, Artificial Sequence; identical to SEQ ID NO: 14166
  neuraminidase__InfluenzaA__ABG88622

SEQ ID NO: 15285 - protein, 469 aa, Artificial Sequence; identical to SEQ ID NO: 14154
  neuraminidase__InfluenzaA__ABG88633

SEQ ID NO: 15286 - protein, 469 aa, Artificial Sequence; identical to SEQ ID NO: 15205
  neuraminidase__InfluenzaA__ABG88655

SEQ ID NO: 15287 - protein, 469 aa, Artificial Sequence; identical to SEQ ID NO: 15205
  neuraminidase__InfluenzaA__ABG88666

SEQ ID NO: 15288 - protein, 469 aa, Artificial Sequence; identical to SEQ ID NO: 14591
  neuraminidase__InfluenzaA__ABG88677

SEQ ID NO: 15289 - protein, 469 aa, Artificial Sequence; identical to SEQ ID NO: 15205
  neuraminidase__InfluenzaA__ABG88688

SEQ ID NO: 15290 - protein, 469 aa, Artificial Sequence; identical to SEQ ID NO: 14591
  neuraminidase__InfluenzaA__ABG88699

SEQ ID NO: 15291 - protein, 469 aa, Artificial Sequence; identical to SEQ ID NO: 14327
  neuraminidase__InfluenzaA__ABG88710

SEQ ID NO: 15292 - protein, 469 aa, Artificial Sequence; identical to SEQ ID NO: 14327
  neuraminidase__InfluenzaA__ABG88721

SEQ ID NO: 15293 - protein, 469 aa, Artificial Sequence
  neuraminidase__InfluenzaA__ABG88732
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVERGNRSGYSGIFSVEGKSCINRCFYVELIRGRKQETEVWWTSNSIVVFCGTSGTYGTGSWPDGADINLMPI

SEQ ID NO: 15294 - protein, 469 aa, Artificial Sequence; identical to SEQ ID NO: 15253
  neuraminidase__InfluenzaA__ABG88743

SEQ ID NO: 15295 - protein, 469 aa, Artificial Sequence; identical to SEQ ID NO: 15253
  neuraminidase__InfluenzaA__ABG88754

SEQ ID NO: 15296 - protein, 469 aa, Artificial Sequence; identical to SEQ ID NO: 14519
  neuraminidase__InfluenzaA__ABG88765

SEQ ID NO: 15297 - protein, 469 aa, Artificial Sequence; identical to SEQ ID NO: 15185
  neuraminidase__InfluenzaA__ABG88776

SEQ ID NO: 15298 - protein, 469 aa, Artificial Sequence; identical to SEQ ID NO: 15185
  neuraminidase__InfluenzaA__ABG88787

SEQ ID NO: 15299 - protein, 469 aa, Artificial Sequence
  neuraminidase__InfluenzaA__ABG88820
MNPNQKIITIGSVSLTISTICFFMQIAILITTVTLHFKQYEFNSPPNNQVMLCEPTIIERNITEIVYLTNTTIEKEKCPKLAEYRNWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 15300 - protein, 449 aa, Artificial Sequence
  neuraminidase__InfluenzaA__ABI16506
MNPNQKIITIGSICMVIGIVSLMLQIGNMVSLWVSHSIQTGNQHQVEPISNTNFLTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGMITDTIKSWRNNILRTQESECVCVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSPSSRSGFEMIWDPNGWTETDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15301 - protein, 470 aa, Artificial Sequence; identical to SEQ ID NO: 14965
  neuraminidase__InfluenzaA__ABI20840

SEQ ID NO: 15302 - protein, 470 aa, Artificial Sequence
  neuraminidase__InfluenzaA__ABI20862
MNPNQKIITIGSICMTIGIISLILQIGNIISIWVSHSIQTGSQNHTGICNQRIITYENSTWVNQTYVNINNTNVVAGKDTTSVTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSNGPASYRIFKIEKGKITKSIELDAPNSHYEECSCYPDTGTVMCVCRDNWHGSNRPWVSFNQNLDYQTGYICSGVFGDNPRPKDGKGSCDPVTVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTANWSWPDGAELPFTIDK

SEQ ID NO: 15303 - protein, 470 aa, Artificial Sequence
  neuraminidase__InfluenzaA__ABI20873
MNPNQKIITIGSISMAIGIISLTLQIGNIISIWASHSIQTGSQNHTGICNQRIITYENSTWVNQTYVNINNTNVVAEKDKTSVTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSATACHDGIGWLTIGISGPDNGAVAVLKYNGVITETIKSWKKQILRTQESECVCVNGSCFTIMTDGPSNGAASYRIFKIEKGKITKSIELDAPNFHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEIIWDPNGWTDTDSDFSVKQDVVAMTDWSGYSGSFVQHPELTGLDCMRPCFWVELVRGLPRENATIWTSGSSISFCGVNSDTANWSWPDGAELPFTIDK

SEQ ID NO: 15304 - protein, 469 aa, Artificial Sequence; identical to SEQ ID NO: 15100
  neuraminidase__InfluenzaA__ABI20895

SEQ ID NO: 15305 - protein, 469 aa, Artificial Sequence; identical to SEQ ID NO: 15113
  neuraminidase__InfluenzaA__ABI20906

SEQ ID NO: 15306 - protein, 469 aa, Artificial Sequence; identical to SEQ ID NO: 15101
  neuraminidase__InfluenzaA__ABI20928

SEQ ID NO: 15307 - protein, 469 aa, Artificial Sequence; identical to SEQ ID NO: 15101
  neuraminidase__InfluenzaA__ABI20939

SEQ ID NO: 15308 - protein, 469 aa, Artificial Sequence; identical to SEQ ID NO: 15101
  neuraminidase__InfluenzaA__ABI20950

SEQ ID NO: 15309 - protein, 469 aa, Artificial Sequence; identical to SEQ ID NO: 15101
  neuraminidase__InfluenzaA__ABI20961

SEQ ID NO: 15310 - protein, 469 aa, Artificial Sequence; identical to SEQ ID NO: 14827
  neuraminidase__InfluenzaA__ABI20983

SEQ ID NO: 15311 - protein, 469 aa, Artificial Sequence
  neuraminidase__InfluenzaA__ABI20994
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHNRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQETEVLWTSNSIVVFCGTSGTYGTGSWPDGADINLMPI

SEQ ID NO: 15312 - protein, 469 aa, Artificial Sequence
  neuraminidase__InfluenzaA__ABI21005
MNPNQKIITIGSVSLTIATICFLMQIAVLVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLADSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15313 - protein, 469 aa, Artificial Sequence; identical to SEQ ID NO: 14154
  neuraminidase__InfluenzaA__ABI21016

SEQ ID NO: 15314 - protein, 469 aa, Artificial Sequence
  neuraminidase__InfluenzaA__ABI21027
MNPNQRIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTPGTYGTGSWPDGADINLMPI

SEQ ID NO: 15315 - protein, 469 aa, Artificial Sequence; identical to SEQ ID NO: 14591
  neuraminidase__InfluenzaA__ABI21038

SEQ ID NO: 15316 - protein, 469 aa, Artificial Sequence
  neuraminidase__InfluenzaA__ABI21049
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSGYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15317 - protein, 469 aa, Artificial Sequence
  neuraminidase__InfluenzaA__ABI21060
MNPNQKIITIGSVSLTIATICFLMQIAILVTTVTLHFKQHECNSPPNNQVMLCEPTIIERNITEIVYLTNTTIEKEICPKPVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15318 - protein, 469 aa, Artificial Sequence
  neuraminidase__InfluenzaA__ABI21071
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMSELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15319 - protein, 469 aa, Artificial Sequence
  neuraminidase__InfluenzaA__ABI21082
MNPNQKIITIGSVSLTISTICFFMQIATLITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15320 - protein, 469 aa, Artificial Sequence; identical to SEQ ID NO: 14736
  neuraminidase__InfluenzaA__ABI21093

SEQ ID NO: 15321 - protein, 469 aa, Artificial Sequence
  neuraminidase__InfluenzaA__ABI21104
MNPNQKIITIGSVSLTISTICFFMQIAILITTVTLHFKQYEFNSPPNNQVMLCEPTIIERNITEIVYLANTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKNCINRCFYVELIRGRKEETEVLWTSNSIVVFCGTSGTYGTGSWPDGADINLMPI

SEQ ID NO: 15322 - protein, 469 aa, Artificial Sequence; identical to SEQ ID NO: 14327
  neuraminidase__InfluenzaA__ABI21115

SEQ ID NO: 15323 - protein, 469 aa, Artificial Sequence; identical to SEQ ID NO: 14327
  neuraminidase__InfluenzaA__ABI21126

SEQ ID NO: 15324 - protein, 469 aa, Artificial Sequence; identical to SEQ ID NO: 14736
  neuraminidase__InfluenzaA__ABI21137

SEQ ID NO: 15325 - protein, 469 aa, Artificial Sequence; identical to SEQ ID NO: 14327
  neuraminidase__InfluenzaA__ABI21148

SEQ ID NO: 15326 - protein, 469 aa, Artificial Sequence
  neuraminidase__InfluenzaA__ABI21159
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSGYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15327 - protein, 469 aa, Artificial Sequence; identical to SEQ ID NO: 14327
  neuraminidase__InfluenzaA__ABI21170

SEQ ID NO: 15328 - protein, 469 aa, Artificial Sequence; identical to SEQ ID NO: 14327
  neuraminidase__InfluenzaA__ABI21181

SEQ ID NO: 15329 - protein, 470 aa, Artificial Sequence
  neuraminidase__InfluenzaA__ABI21192
MNPNQKIITIGSISIAIGIISLMLQIGNIISIWASHSIQTGSQNHTGTCNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWRKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFIIDK

SEQ ID NO: 15330 - protein, 470 aa, Artificial Sequence; identical to SEQ ID NO: 14386
  neuraminidase__InfluenzaA__ABI21203

SEQ ID NO: 15331 - protein, 470 aa, Artificial Sequence
  neuraminidase__InfluenzaA__ABI21214
MNPNQKIITIGSISIAIGIISLMLQIGNIISIWASHSIQTGSQNHTGICNQRIITYENSTWVNHTYVNINNTNVVAGKDITSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 15332 - protein, 469 aa, Artificial Sequence
  neuraminidase__InfluenzaA__ABI21247
MNPNQKIITIGSVSLTIATICFLMQIAILVTTVTLHFKQYECNSPPNNQVMLCEPTIIERNITEIVYLTNTTIEKEKCPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDHSIVSSYVCSGLVGDTPRKNDSSSSSYCRNPNNEKGSHGMKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15333 - protein, 469 aa, Artificial Sequence; identical to SEQ ID NO: 15253
  neuraminidase__InfluenzaA__ABI21258

SEQ ID NO: 15334 - protein, 469 aa, Artificial Sequence; identical to SEQ ID NO: 15253
  neuraminidase__InfluenzaA__ABI21269

SEQ ID NO: 15335 - protein, 469 aa, Artificial Sequence; identical to SEQ ID NO: 15253
  neuraminidase__InfluenzaA__ABI21280

SEQ ID NO: 15336 - protein, 469 aa, Artificial Sequence; identical to SEQ ID NO: 15185
  neuraminidase__InfluenzaA__ABI21302

SEQ ID NO: 15337 - protein, 469 aa, Artificial Sequence; identical to SEQ ID NO: 15185
  neuraminidase__InfluenzaA__ABI21313

SEQ ID NO: 15338 - protein, 469 aa, Artificial Sequence; identical to SEQ ID NO: 15185
  neuraminidase__InfluenzaA__ABI21324

SEQ ID NO: 15339 - protein, 469 aa, Artificial Sequence; identical to SEQ ID NO: 15185
  neuraminidase__InfluenzaA__ABI21335

SEQ ID NO: 15340 - protein, 469 aa, Artificial Sequence; identical to SEQ ID NO: 15253
  neuraminidase__InfluenzaA__ABI21346

SEQ ID NO: 15341 - protein, 469 aa, Artificial Sequence
  neuraminidase__InfluenzaA__ABI21357
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKNYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQEAEVWWTSNSIVVFCGTSGTYGTGSWPDGADINLMPI

SEQ ID NO: 15342 - protein, 469 aa, Artificial Sequence; identical to SEQ ID NO: 15185
  neuraminidase__InfluenzaA__ABI21368

SEQ ID NO: 15343 - protein, 469 aa, Artificial Sequence; identical to SEQ ID NO: 15185
  neuraminidase__InfluenzaA__ABI21379

SEQ ID NO: 15344 - protein, 469 aa, Artificial Sequence; identical to SEQ ID NO: 15185
  neuraminidase__InfluenzaA__ABI21390

SEQ ID NO: 15345 - protein, 469 aa, Artificial Sequence; identical to SEQ ID NO: 15253
  neuraminidase__InfluenzaA__ABI21401

SEQ ID NO: 15346 - protein, 469 aa, Artificial Sequence
  neuraminidase__InfluenzaA__ABI21412
MNPNQKIITIGSVSLTIATICFLMQIAILVTTVTLHFKQYECNPPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15347 - protein, 469 aa, Artificial Sequence; identical to SEQ ID NO: 14519
  neuraminidase__InfluenzaA__ABI21423

SEQ ID NO: 15348 - protein, 469 aa, Artificial Sequence; identical to SEQ ID NO: 15185
  neuraminidase__InfluenzaA__ABI21434

SEQ ID NO: 15349 - protein, 469 aa, Artificial Sequence; identical to SEQ ID NO: 15253
  neuraminidase__InfluenzaA__ABI21445

SEQ ID NO: 15350 - protein, 469 aa, Artificial Sequence; identical to SEQ ID NO: 15253
  neuraminidase__InfluenzaA__ABI21456

SEQ ID NO: 15351 - protein, 469 aa, Artificial Sequence; identical to SEQ ID NO: 15346
  neuraminidase__InfluenzaA__ABI21467

SEQ ID NO: 15352 - protein, 469 aa, Artificial Sequence; identical to SEQ ID NO: 15253
  neuraminidase__InfluenzaA__ABI21478

SEQ ID NO: 15353 - protein, 469 aa, Artificial Sequence; identical to SEQ ID NO: 15253
  neuraminidase__InfluenzaA__ABI21489

SEQ ID NO: 15354 - protein, 469 aa, Artificial Sequence; identical to SEQ ID NO: 15253
  neuraminidase__InfluenzaA__ABI21500

SEQ ID NO: 15355 - protein, 469 aa, Artificial Sequence
  neuraminidase__InfluenzaA__ABI21511
MNPNQKIITIGSVSLTIATICFLMQIAILVTTVTLHFKQYECNSPPNNQVMLCEPAIIERNITEIVYLTNTTIEKEMCPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYDGRLVDSIGSWSKKILRTQESECVCINGTCTVVMTDGSASGKADTKILFIEEGKIVNISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15356 - protein, 470 aa, Artificial Sequence
  neuraminidase__InfluenzaA__ABI21533
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVMREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVIKSIELNAPNSHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGRPRENTTIWTSGSSISFCGVNSDTANWSWPDGAELPFTIDK

SEQ ID NO: 15357 - protein, 470 aa, Artificial Sequence; identical to SEQ ID NO: 15356
  neuraminidase__InfluenzaA__ABI21544

SEQ ID NO: 15358 - protein, 470 aa, Artificial Sequence; identical to SEQ ID NO: 15356
  neuraminidase__InfluenzaA__ABI21555

SEQ ID NO: 15359 - protein, 470 aa, Artificial Sequence; identical to SEQ ID NO: 15356
  neuraminidase__InfluenzaA__ABI21566

SEQ ID NO: 15360 - protein, 470 aa, Artificial Sequence; identical to SEQ ID NO: 15356
  neuraminidase__InfluenzaA__ABI21577

SEQ ID NO: 15361 - protein, 470 aa, Artificial Sequence
  neuraminidase__InfluenzaA__ABI22112
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNEIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 15362 - protein, 469 aa, Artificial Sequence
  neuraminidase__InfluenzaA__ABI22162
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGADIDLMPI

SEQ ID NO: 15363 - protein, 449 aa, Artificial Sequence
  neuraminidase__InfluenzaA__ABI23981
MNPNQKIITIGSICMVIGIVSLMLQIGNMISIWVSHSIQTGNQRQAESISNTKFLTEKAVASVTLAGNSSLCPISGWAVYSKDNSIRIGSRGDVFVIREPFISCSHLECRTFFLTQGALLNDKHSNGTVKDRSPYRTLMSSPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPVSLNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15364 - protein, 469 aa, Artificial Sequence; identical to SEQ ID NO: 14327
  neuraminidase__InfluenzaA__ABI26649

SEQ ID NO: 15365 - protein, 470 aa, Artificial Sequence; identical to SEQ ID NO: 15050
  neuraminidase__InfluenzaA__ABI30370

SEQ ID NO: 15366 - protein, 469 aa, Artificial Sequence; identical to SEQ ID NO: 15101
  neuraminidase__InfluenzaA__ABI30392

SEQ ID NO: 15367 - protein, 469 aa, Artificial Sequence; identical to SEQ ID NO: 14730
  neuraminidase__InfluenzaA__ABI30403

SEQ ID NO: 15368 - protein, 469 aa, Artificial Sequence; identical to SEQ ID NO: 14730
  neuraminidase__InfluenzaA__ABI30414

SEQ ID NO: 15369 - protein, 469 aa, Artificial Sequence; identical to SEQ ID NO: 14327
  neuraminidase__InfluenzaA__ABI30425

SEQ ID NO: 15370 - protein, 469 aa, Artificial Sequence; identical to SEQ ID NO: 14327
  neuraminidase__InfluenzaA__ABI30436

SEQ ID NO: 15371 - protein, 469 aa, Artificial Sequence; identical to SEQ ID NO: 14327
  neuraminidase__InfluenzaA__ABI30447

SEQ ID NO: 15372 - protein, 469 aa, Artificial Sequence; identical to SEQ ID NO: 14327
  neuraminidase__InfluenzaA__ABI30458

SEQ ID NO: 15373 - protein, 469 aa, Artificial Sequence; identical to SEQ ID NO: 14327
  neuraminidase__InfluenzaA__ABI30469

SEQ ID NO: 15374 - protein, 469 aa, Artificial Sequence; identical to SEQ ID NO: 14327
  neuraminidase__InfluenzaA__ABI30480

SEQ ID NO: 15375 - protein, 469 aa, Artificial Sequence
  neuraminidase__InfluenzaA__ABI30491
MNPNQKIITIGSVSLTISTICFFMQIAILITTVTLHFKQYEFNSPPNNQVMLCEPTIIERNITKIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15376 - protein, 469 aa, Artificial Sequence; identical to SEQ ID NO: 14327
  neuraminidase__InfluenzaA__ABI30502

SEQ ID NO: 15377 - protein, 469 aa, Artificial Sequence
  neuraminidase__InfluenzaA__ABI30513
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 15378 - protein, 469 aa, Artificial Sequence; identical to SEQ ID NO: 14327
  neuraminidase__InfluenzaA__ABI30524

SEQ ID NO: 15379 - protein, 469 aa, Artificial Sequence; identical to SEQ ID NO: 14327
  neuraminidase__InfluenzaA__ABI30535

SEQ ID NO: 15380 - protein, 469 aa, Artificial Sequence
  neuraminidase__InfluenzaA__ABI30546
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNLHSNDTVHDRTPYRTLLMSELGVPFHLGTKQVCIAWSSSSCHDGKAWMHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKNCINRCFYVELIRGRKEETEVLWTSNSIVVFCGTSGTYGTGSWPDGADINLMPI

SEQ ID NO: 15381 - protein, 469 aa, Artificial Sequence; identical to SEQ ID NO: 14327
  neuraminidase__InfluenzaA__ABI30557

SEQ ID NO: 15382 - protein, 469 aa, Artificial Sequence; identical to SEQ ID NO: 14714
  neuraminidase__InfluenzaA__ABI30579

SEQ ID NO: 15383 - protein, 469 aa, Artificial Sequence
  neuraminidase__InfluenzaA__ABI30590
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKGCINRCFYVELIRGRKEETEVLWTSNSIVVFCGTSGTYGTGSWPDGADINLMPI

SEQ ID NO: 15384 - protein, 469 aa, Artificial Sequence; identical to SEQ ID NO: 14807
  neuraminidase__InfluenzaA__ABI30601

SEQ ID NO: 15385 - protein, 469 aa, Artificial Sequence
  neuraminidase__InfluenzaA__ABI30612
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIIHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15386 - protein, 469 aa, Artificial Sequence; identical to SEQ ID NO: 14807
  neuraminidase__InfluenzaA__ABI30623

SEQ ID NO: 15387 - protein, 469 aa, Artificial Sequence
  neuraminidase__InfluenzaA__ABI30736
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSVVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15388 - protein, 469 aa, Artificial Sequence
  neuraminidase__InfluenzaA__ABI30758
MNPNQKIITIGSVSLTISTICFFMQIAILITTVTLHFKQYEFNSPPNNQVMLYEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15389 - protein, 469 aa, Artificial Sequence; identical to SEQ ID NO: 14714
  neuraminidase__InfluenzaA__ABI30769

SEQ ID NO: 15390 - protein, 469 aa, Artificial Sequence; identical to SEQ ID NO: 14714
  neuraminidase__InfluenzaA__ABI30780

SEQ ID NO: 15391 - protein, 469 aa, Artificial Sequence; identical to SEQ ID NO: 14714
  neuraminidase__InfluenzaA__ABI30791

SEQ ID NO: 15392 - protein, 469 aa, Artificial Sequence; identical to SEQ ID NO: 14714
  neuraminidase__InfluenzaA__ABI30802

SEQ ID NO: 15393 - protein, 469 aa, Artificial Sequence; identical to SEQ ID NO: 14714
  neuraminidase__InfluenzaA__ABI30813

SEQ ID NO: 15394 - protein, 469 aa, Artificial Sequence; identical to SEQ ID NO: 14714
  neuraminidase__InfluenzaA__ABI30824

SEQ ID NO: 15395 - protein, 469 aa, Artificial Sequence; identical to SEQ ID NO: 14714
  neuraminidase__InfluenzaA__ABI30835

SEQ ID NO: 15396 - protein, 469 aa, Artificial Sequence; identical to SEQ ID NO: 14714
  neuraminidase__InfluenzaA__ABI30846

SEQ ID NO: 15397 - protein, 469 aa, Artificial Sequence; identical to SEQ ID NO: 15185
  neuraminidase__InfluenzaA__ABI30857

SEQ ID NO: 15398 - protein, 469 aa, Artificial Sequence; identical to SEQ ID NO: 15185
  neuraminidase__InfluenzaA__ABI30868

SEQ ID NO: 15399 - protein, 449 aa, Artificial Sequence
  neuraminidase__InfluenzaA__ABI36157
MNPNQKIITIGSICMAIGTVSLMLQIGNMISIWVSHSIQTGNQHQAESISNTNPLTEKAVASVTLAGNSSLCPIRGWAVHSKDNSIRIGSKGDVFVIREPFISCSHSECRTFFLTQGALLNDKHSNETVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSSNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15400 - protein, 449 aa, Artificial Sequence; identical to SEQ ID NO: 15399
  neuraminidase__InfluenzaA__ABI36168

SEQ ID NO: 15401 - protein, 449 aa, Artificial Sequence; identical to SEQ ID NO: 15399
  neuraminidase__InfluenzaA__ABI36179

SEQ ID NO: 15402 - protein, 449 aa, Artificial Sequence; identical to SEQ ID NO: 15399
  neuraminidase__InfluenzaA__ABI36189

SEQ ID NO: 15403 - protein, 449 aa, Artificial Sequence
  neuraminidase__InfluenzaA__ABI36278
MNPNQKIITIGSICMVIGIVSLMLQIGNMISIWVSHSIQKGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15404 - protein, 449 aa, Artificial Sequence; identical to SEQ ID NO: 15403
  neuraminidase__InfluenzaA__ABI36287

SEQ ID NO: 15405 - protein, 449 aa, Artificial Sequence; identical to SEQ ID NO: 15403
  neuraminidase__InfluenzaA__ABI36298

SEQ ID NO: 15406 - protein, 449 aa, Artificial Sequence
  neuraminidase__InfluenzaA__ABI36314
MNPNQKIITIGSICMVIGIVSLMLQIGNMISIWVSHSIQTGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGNSWLTIGISGPDNEAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15407 - protein, 449 aa, Artificial Sequence
  neuraminidase__InfluenzaA__ABI36336
MNPNQKIITIGSICMVIGIVSLMLQIGNMISIWVSHSVQTGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPLGEAPSPYNSRFESVSWSASACHDGTSWLTIGISGPDNEAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSIISFCGVNSDTVSWSWPDGAELPFTIDK

SEQ ID NO: 15408 - protein, 449 aa, Artificial Sequence
  neuraminidase__InfluenzaA__ABI36358
MNPNQKIITIGSICMVIGIVSLMLQIGNMISIWVSHSVQTGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15409 - protein, 449 aa, Artificial Sequence; identical to SEQ ID NO: 15399
  neuraminidase__InfluenzaA__ABI36369

SEQ ID NO: 15410 - protein, 449 aa, Artificial Sequence
  neuraminidase__InfluenzaA__ABI36391
MNPNQKIITIGSICMVIGIVSLMLQIGNMISIWVSHSTQKGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGIFGDNPRPNDGTGSCGPMFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15411 - protein, 449 aa, Artificial Sequence; identical to SEQ ID NO: 15410
  neuraminidase__InfluenzaA__ABI36402

SEQ ID NO: 15412 - protein, 449 aa, Artificial Sequence; identical to SEQ ID NO: 15399
  neuraminidase__InfluenzaA__ABI36413

SEQ ID NO: 15413 - protein, 449 aa, Artificial Sequence
  neuraminidase__InfluenzaA__ABI36446
MNPNQKIITIGSICMVIGIVSLMLQIGNMISIWVSHSIQTGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWISFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15414 - protein, 449 aa, Artificial Sequence; identical to SEQ ID NO: 15403
  neuraminidase__InfluenzaA__ABI36457

SEQ ID NO: 15415 - protein, 449 aa, Artificial Sequence
  neuraminidase__InfluenzaA__ABI36476
MNPNQKIITIGSICMVIGIVSLMLQIGNMISIWVSHSTQKGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15416 - protein, 449 aa, Artificial Sequence
  neuraminidase__InfluenzaA__ABI49409
MNPNRKIITIGSICMVIGMVSLMLQIGNMISIWVSHSIQTGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMEKGKVVKSVELVAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTASWSWPDGAELPFTIDK

SEQ ID NO: 15417 - protein, 449 aa, Artificial Sequence
  neuraminidase__InfluenzaA__ABI49417
MNPNQKIITIGSICMVIGIVSLMLQIGNMISIWVSHSIQTGNQHQAESISNTNPLTEKAVASVTLAGNSSLCPIRGWAVHSKDNNIRIGSKGDVFVIREPFISCSHLECRTFFLTRGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGQPKESTIWTSGSSISFCGVNSDTVSWSWPDGAELPFTIDK

SEQ ID NO: 15418 - protein, 469 aa, Artificial Sequence
  neuraminidase__InfluenzaA__ABI84962
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 15419 - protein, 469 aa, Artificial Sequence
  neuraminidase__InfluenzaA__ABI85003
MNPNQKIITIGVVNTTLSTIALLIGVGNLVFNTVIHEKIGDHQIVTHPTIMTPEVPNCSDTIITYNNTVINNITTTIITEAERPFKSPLPLCPFRGFFPFHKDNAIRLGENKDVIVTREPYVSCDNDNCWSFALAQGALLGTKHSNGTIKDRTPYRSLIRFPIGTAPVLGNYKEICIAWSSSSCFDGKEWMHVCMTGNDNDASAQIIYGGRMTDSIKSWRKDILRTQESECQCIDGTCVVAVTDGPAANSADHRVYWIREGRIIKYENVPKTKIQHLEECSCYVDIDVYCICRDNWKGSNRPWMRINNETILETGYVCSKFHSDTPRPADPSIMSCDSPSNVNGGPGVKGFGFKAGNDVWLGRTVSTSGRSGFEIIKVTEGWINSPNHVKSITQTLVSNNDWSGYSGSFIVKAKDCFQPCFYVELIRGRPNKNDDVSWTSNSIVTFCGLDNEPGSGNWPDGSNIGFMPK

SEQ ID NO: 15420 - protein, 469 aa, Artificial Sequence; identical to SEQ ID NO: 15090
  neuraminidase__InfluenzaA__ABI92294

SEQ ID NO: 15421 - protein, 470 aa, Artificial Sequence
  neuraminidase__InfluenzaA__ABI92305
MNPNQKIITIGSICMAIGIISLILQIGNIISIWVSHLIQTGSQNHTGICNQRIITYENSTWVNQTYVNINNTNVVAGKDTTSVTLAGNSSLCPVRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCINGSCFTIMTDGPSNGPASYRIFKIEKGKITKSIELDAPNSHYEECSCYPDTGTVMCVCRDNWHGSNRPWVSFNQNLDYQIGYICSGVFGDNPRPKDGKGSCGPVTVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 15422 - protein, 470 aa, Artificial Sequence
  neuraminidase__InfluenzaA__ABI92316
MNPNQKIITIGSISIAIGVISLILQIGNIISIWASHSIQTGSQNHTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCVNGSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 15423 - protein, 469 aa, Artificial Sequence; identical to SEQ ID NO: 15101
  neuraminidase__InfluenzaA__ABI92327

SEQ ID NO: 15424 - protein, 469 aa, Artificial Sequence
  neuraminidase__InfluenzaA__ABI92338
MNPNQKIITIGSVSLTIATICFLMQIAILVTTVTLHFKQYECNSPPNNQVMLCEPAIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVNISTLSGSAQHVEECSCYPRYPGVRCVCRDNWKGSNRPIIDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15425 - protein, 469 aa, Artificial Sequence
  neuraminidase__InfluenzaA__ABI92349
MNPNQKIITIGSVSLTIATICFLMQIAILVTTVTLHFKQYECNSPPNNQVMLCEPTIIERNITEIVYLTNTTIEKEICPKLAKYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWIGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15426 - protein, 469 aa, Artificial Sequence; identical to SEQ ID NO: 14327
  neuraminidase__InfluenzaA__ABI92360

SEQ ID NO: 15427 - protein, 469 aa, Artificial Sequence; identical to SEQ ID NO: 14327
  neuraminidase__InfluenzaA__ABI92371

SEQ ID NO: 15428 - protein, 470 aa, Artificial Sequence; identical to SEQ ID NO: 14386
  neuraminidase__InfluenzaA__ABI92382

SEQ ID NO: 15429 - protein, 469 aa, Artificial Sequence; identical to SEQ ID NO: 14714
  neuraminidase__InfluenzaA__ABI92393

SEQ ID NO: 15430 - protein, 469 aa, Artificial Sequence; identical to SEQ ID NO: 14327
  neuraminidase__InfluenzaA__ABI92404

SEQ ID NO: 15431 - protein, 469 aa, Artificial Sequence
  neuraminidase__InfluenzaA__ABI92415
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINFMPI

SEQ ID NO: 15432 - protein, 469 aa, Artificial Sequence; identical to SEQ ID NO: 14714
  neuraminidase__InfluenzaA__ABI92426

SEQ ID NO: 15433 - protein, 469 aa, Artificial Sequence; identical to SEQ ID NO: 14714
  neuraminidase__InfluenzaA__ABI92437

SEQ ID NO: 15434 - protein, 469 aa, Artificial Sequence; identical to SEQ ID NO: 14714
  neuraminidase__InfluenzaA__ABI92448

SEQ ID NO: 15435 - protein, 469 aa, Artificial Sequence; identical to SEQ ID NO: 14714
  neuraminidase__InfluenzaA__ABI92459

SEQ ID NO: 15436 - protein, 469 aa, Artificial Sequence
  neuraminidase__InfluenzaA__ABI92470
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASEKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQETEVLWTSNSIVVFCGTSGTYGTGSWPDGADINLMPI

SEQ ID NO: 15437 - protein, 469 aa, Artificial Sequence; identical to SEQ ID NO: 14730
  neuraminidase__InfluenzaA__ABI92481

SEQ ID NO: 15438 - protein, 469 aa, Artificial Sequence; identical to SEQ ID NO: 14730
  neuraminidase__InfluenzaA__ABI92492

SEQ ID NO: 15439 - protein, 469 aa, Artificial Sequence
  neuraminidase__InfluenzaA__ABI92503
MNPNQKIITIGSVSLTIATICFLMQIAILVTTVTLHFKQYECNSPPNNQVMLCEPTIIERNITEIVYLTNTTIEKEICPKLEEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQETEVLWTSNSIVVFCGTSGTYGTGSWPDGADINLMPI

SEQ ID NO: 15440 - protein, 469 aa, Artificial Sequence
  neuraminidase__InfluenzaA__ABI92514
MNPNQKIITIGSVSLTIATICFLVQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGDDENATASFIYDGRLVDSIGSWSKKILRTQESECVCINGTCTVVMTDGSASGRADTKILFIEEGKIVHTSKLSGSAQHVEECSCYPRYPGVRCVCRDNWKGSNRPIVDINVKDYSIVSSYVCSGLVGDTPRKNDSSSSSHCLDPNNEEGGHGVKGWAFDDGDDVWMGRTISEKSRSGYETFKVIEGWSKPNSKLQINRQVIVERGNMSGYSGIFSVEGKSCINRCFYVELIRGRKQETEVWWTSNSIVVFCGTSGTYGTGSWPDGADINLMPI

SEQ ID NO: 15441 - protein, 469 aa, Artificial Sequence
  neuraminidase__InfluenzaA__ABI92525
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15442 - protein, 469 aa, Artificial Sequence
  neuraminidase__InfluenzaA__ABI92536
MNPNQKIITIGSVSLTIATICFLMQIAILVTTVTLHFKQYECNSPPNNQVMLCEPTIIERNITEIVYLTNTTIEKEKCPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGAGSWPDGADINLMPI

SEQ ID NO: 15443 - protein, 469 aa, Artificial Sequence
  neuraminidase__InfluenzaA__ABI92547
MNPNQKIITIGSVSLTIATICFLMQIAILVTTVTLHFKQYECNSPPNNQVMLCEPTIIERNITEIVYLTNTTIEKEMCPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGAGSWPDGADINLMPI

SEQ ID NO: 15444 - protein, 469 aa, Artificial Sequence
  neuraminidase__InfluenzaA__ABI92558
MNPNQKIITIGSVSLTIATICFLMQIAILVTTVTLHFKQYECNSPPNNQVMLCEPTIIERNITEIVYLTNTTIEKEICPKLAEYRNWSRPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15445 - protein, 469 aa, Artificial Sequence
  neuraminidase__InfluenzaA__ABI92569
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGKLVDSIGSWSKKILRTQESECVCINGTCAVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15446 - protein, 469 aa, Artificial Sequence
  neuraminidase__InfluenzaA__ABI92580
MNPNQKIITIGSVSLTIATICFLMQIAILVTTVTLHFKQYECNSPPNNKVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKGCINRCFYVELIRGRKEETEVWWTSNSIVVFCGTSGTYGTGSWPDGADINLMPI

SEQ ID NO: 15447 - protein, 469 aa, Artificial Sequence
  neuraminidase__InfluenzaA__ABI92591
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLRTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSLSSSHCLDPNNEEGGHGVKGWAFDDGNDVWMGRTISEKLRSGYETFKVIEGWSKPNSKLQINRQVIVERGNRSGYSGIFSVEGKGCINRCFYVELIRGRKEETEVWWTSNSIVVFCGTSGTYGTGSWPDGADINLMPI

SEQ ID NO: 15448 - protein, 469 aa, Artificial Sequence
  neuraminidase__InfluenzaA__ABI92602
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASLIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQVNRQVIVERGNRSGYSGIFSVEGKSCINRCFYVELIRGRKEETEVWWTSNSIVVFCGTSGTYGTGSWPDGADINLMPI

SEQ ID NO: 15449 - protein, 469 aa, Artificial Sequence
  neuraminidase__InfluenzaA__ABI92613
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDNENATASFIYNGKLVDSIGSWSKKILRTQESECVCINGTCAVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15450 - protein, 469 aa, Artificial Sequence
  neuraminidase__InfluenzaA__ABI92624
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVIREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDHSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15451 - protein, 469 aa, Artificial Sequence
  neuraminidase__InfluenzaA__ABI92635
MNPNQKIITIGSVSLTIATICFLMQIAILVTTVTLHFKQYECNPPPNNQVMLCEPTIIERNITEIVYLTNTTIEKEICPKLAEYRNWSKPQCNLTGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKIIFIEEGKIVHTSTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15452 - protein, 469 aa, Artificial Sequence; identical to SEQ ID NO: 14145
  neuraminidase__InfluenzaA__ABI92646

SEQ ID NO: 15453 - protein, 469 aa, Artificial Sequence; identical to SEQ ID NO: 14145
  neuraminidase__InfluenzaA__ABI92657

SEQ ID NO: 15454 - protein, 469 aa, Artificial Sequence
  neuraminidase__InfluenzaA__ABI92668
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCGPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15455 - protein, 469 aa, Artificial Sequence; identical to SEQ ID NO: 14591
  neuraminidase__InfluenzaA__ABI92679

SEQ ID NO: 15456 - protein, 469 aa, Artificial Sequence; identical to SEQ ID NO: 14145
  neuraminidase__InfluenzaA__ABI92701

SEQ ID NO: 15457 - protein, 469 aa, Artificial Sequence
  neuraminidase__InfluenzaA__ABI92712
MNPNQKIITIGSVSLTIATICFLMQIAILVTTVTLHFKQHECNSPPNNQAMLCEPTTTERNTTEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15458 - protein, 469 aa, Artificial Sequence
  neuraminidase__InfluenzaA__ABI92723
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15459 - protein, 469 aa, Artificial Sequence; identical to SEQ ID NO: 14145
  neuraminidase__InfluenzaA__ABI92734

SEQ ID NO: 15460 - protein, 469 aa, Artificial Sequence; identical to SEQ ID NO: 14591
  neuraminidase__InfluenzaA__ABI92745

SEQ ID NO: 15461 - protein, 469 aa, Artificial Sequence
  neuraminidase__InfluenzaA__ABI92756
MNPNQKIITIGSVSLTIATICFLMQIAILVTTVTLHFKQHECNSPPNNQVILCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15462 - protein, 469 aa, Artificial Sequence
  neuraminidase__InfluenzaA__ABI92767
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEKTEVWWTSNSIVVFCGTSGTYGTGSWPDGADINLMPI

SEQ ID NO: 15463 - protein, 469 aa, Artificial Sequence; identical to SEQ ID NO: 14145
  neuraminidase__InfluenzaA__ABI92778

SEQ ID NO: 15464 - protein, 469 aa, Artificial Sequence; identical to SEQ ID NO: 14327
  neuraminidase__InfluenzaA__ABI92789

SEQ ID NO: 15465 - protein, 469 aa, Artificial Sequence; identical to SEQ ID NO: 14327
  neuraminidase__InfluenzaA__ABI92800

SEQ ID NO: 15466 - protein, 469 aa, Artificial Sequence; identical to SEQ ID NO: 14327
  neuraminidase__InfluenzaA__ABI92811

SEQ ID NO: 15467 - protein, 469 aa, Artificial Sequence; identical to SEQ ID NO: 14327
  neuraminidase__InfluenzaA__ABI92822

SEQ ID NO: 15468 - protein, 469 aa, Artificial Sequence; identical to SEQ ID NO: 14327
  neuraminidase__InfluenzaA__ABI92844

SEQ ID NO: 15469 - protein, 469 aa, Artificial Sequence; identical to SEQ ID NO: 14327
  neuraminidase__InfluenzaA__ABI92855

SEQ ID NO: 15470 - protein, 469 aa, Artificial Sequence
  neuraminidase__InfluenzaA__ABI92866
MNPNQKIITIGSASLTIATICFLIQIAILVTTVTLHFKQHECNSLPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSISSWSKKILRTQESECVCINGTCTVVMTDGSASGKADTKILFIEEGKIIHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSNPNSKLQINRQVIVERGNRSGYSGIFSVEGKSCINRCFYVELIRGRKEETEVWWTSNSIVVFCGTSGTYGTGSWPDGADINLMPI

SEQ ID NO: 15471 - protein, 469 aa, Artificial Sequence; identical to SEQ ID NO: 14327
  neuraminidase__InfluenzaA__ABI92877

SEQ ID NO: 15472 - protein, 469 aa, Artificial Sequence; identical to SEQ ID NO: 14327
  neuraminidase__InfluenzaA__ABI92888

SEQ ID NO: 15473 - protein, 469 aa, Artificial Sequence; identical to SEQ ID NO: 14327
  neuraminidase__InfluenzaA__ABI92899

SEQ ID NO: 15474 - protein, 469 aa, Artificial Sequence; identical to SEQ ID NO: 14327
  neuraminidase__InfluenzaA__ABI92910

SEQ ID NO: 15475 - protein, 469 aa, Artificial Sequence; identical to SEQ ID NO: 14327
  neuraminidase__InfluenzaA__ABI92921

SEQ ID NO: 15476 - protein, 469 aa, Artificial Sequence; identical to SEQ ID NO: 14327
  neuraminidase__InfluenzaA__ABI92932

SEQ ID NO: 15477 - protein, 469 aa, Artificial Sequence; identical to SEQ ID NO: 14714
  neuraminidase__InfluenzaA__ABI92943

SEQ ID NO: 15478 - protein, 469 aa, Artificial Sequence; identical to SEQ ID NO: 14714
  neuraminidase__InfluenzaA__ABI92954

SEQ ID NO: 15479 - protein, 469 aa, Artificial Sequence
  neuraminidase__InfluenzaA__ABI92965
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDRSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15480 - protein, 469 aa, Artificial Sequence; identical to SEQ ID NO: 14714
  neuraminidase__InfluenzaA__ABI92976

SEQ ID NO: 15481 - protein, 469 aa, Artificial Sequence; identical to SEQ ID NO: 14714
  neuraminidase__InfluenzaA__ABI92987

SEQ ID NO: 15482 - protein, 469 aa, Artificial Sequence; identical to SEQ ID NO: 14714
  neuraminidase__InfluenzaA__ABI92998

SEQ ID NO: 15483 - protein, 469 aa, Artificial Sequence; identical to SEQ ID NO: 14918
  neuraminidase__InfluenzaA__ABI93009

SEQ ID NO: 15484 - protein, 469 aa, Artificial Sequence; identical to SEQ ID NO: 14714
  neuraminidase__InfluenzaA__ABI93020

SEQ ID NO: 15485 - protein, 470 aa, Artificial Sequence; identical to SEQ ID NO: 15356
  neuraminidase__InfluenzaA__ABI93031

SEQ ID NO: 15486 - protein, 469 aa, Artificial Sequence; identical to SEQ ID NO: 15111
  neuraminidase__InfluenzaA__ABI93042

SEQ ID NO: 15487 - protein, 469 aa, Artificial Sequence; identical to SEQ ID NO: 14284
  neuraminidase__InfluenzaA__ABI93053

SEQ ID NO: 15488 - protein, 469 aa, Artificial Sequence
  neuraminidase__InfluenzaA__ABI93064
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHTSKLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIVERGNRSGYSGIFSVEGKSCINRCFYVELIRGRKQETEVWWTSNSIVVFCGTSGTYGTGSWPDGADINLMPI

SEQ ID NO: 15489 - protein, 469 aa, Artificial Sequence; identical to SEQ ID NO: 14730
  neuraminidase__InfluenzaA__ABI93075

SEQ ID NO: 15490 - protein, 469 aa, Artificial Sequence; identical to SEQ ID NO: 14730
  neuraminidase__InfluenzaA__ABI93086

SEQ ID NO: 15491 - protein, 469 aa, Artificial Sequence; identical to SEQ ID NO: 14730
  neuraminidase__InfluenzaA__ABI93097

SEQ ID NO: 15492 - protein, 469 aa, Artificial Sequence
  neuraminidase__InfluenzaA__ABI93108
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVNDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQETEVLWTSNSIVVFCGTSGTYGTGSWPDGADINLMPI

SEQ ID NO: 15493 - protein, 469 aa, Artificial Sequence
  neuraminidase__InfluenzaA__ABI93119
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDNSSSSHCLDPNNEEGGHGVKGWAFDDGNDVWMGRTISEKLRSGYETFKVIEGWSKPNSKLQINRQVIVDRSNRSGYSGIFSVESKSCINRCFYVELIRGRKQETEVLWTSNSIVVFCGTSGTYGTGSWPDGADINLMPI

SEQ ID NO: 15494 - protein, 471 aa, Artificial Sequence
  neuraminidase__InfluenzaA__ABI94584
MNPNQKLFALSGVAIALSVLNLLIGISNVGLNVSLHLKEKGPKQEENLTCTTINQNNTTVVENTYVNNTTIITKGTDLKTPSYLLLNKSLCNVEGWVVIAKDNAVRFGESEQIIVTREPYVSCDPTGCKMYALHQGTTIRNKHSNGTIHDRTAFRGLISTPLGTPPTVSNSDFMCVGWSSTTCHDGIARMTICIQGNNDNATATVYYNRRLTTTIKTWARNILRTQESECVCHNGTCAVVMTDGSASSQAYTKVMYFHKGLVVKEEELRGSARHIEECSCYGHNQKVTCVCRDNWQGANRPIIEIDMSTLEHTSRYVCTGILTDTSRPGDKSSGDCSNPITGSPGVPGVKGFGFLNGDNTWLGRTISPRSRSGFEMLKIPNAGTDPNSRIAERQEIVDNNNWSGYSGSFIDYWNDNSECYNPCFYVELIRGRPEEAKYVWWASNSLIALCGSPFPVGSGSFPDGAQIQYFS

SEQ ID NO: 15495 - protein, 470 aa, Artificial Sequence; identical to SEQ ID NO: 14828
  neuraminidase__InfluenzaA__ABI95220

SEQ ID NO: 15496 - protein, 469 aa, Artificial Sequence
  neuraminidase__InfluenzaA__ABI95242
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHGRTPYRTLLMNELGVPFHLGTKQVCIAWSSSSCHDGKAWLHVCVTGDDKNATASFIYNGRLVDSIVSWSKEILRTQESECVCINGTCTVVMTDGSASGEADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15497 - protein, 470 aa, Artificial Sequence
  neuraminidase__InfluenzaA__ABI95253
MNPNQKIITIGSISIAIGIISIMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSDGAASYKIFKIEKGKVTKSIELNAPNSHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGRPRENTTIWTSGSSISFCGVNSDTANWSWPDGAELPFTIDK

SEQ ID NO: 15498 - protein, 470 aa, Artificial Sequence; identical to SEQ ID NO: 15356
  neuraminidase__InfluenzaA__ABI95264

SEQ ID NO: 15499 - protein, 470 aa, Artificial Sequence; identical to SEQ ID NO: 15356
  neuraminidase__InfluenzaA__ABI95275

SEQ ID NO: 15500 - protein, 470 aa, Artificial Sequence; identical to SEQ ID NO: 15356
  neuraminidase__InfluenzaA__ABI95286

SEQ ID NO: 15501 - protein, 470 aa, Artificial Sequence
  neuraminidase__InfluenzaA__ABI95297
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKNRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 15502 - protein, 469 aa, Artificial Sequence; identical to SEQ ID NO: 14730
  neuraminidase__InfluenzaA__ABI95308

SEQ ID NO: 15503 - protein, 470 aa, Artificial Sequence; identical to SEQ ID NO: 14386
  neuraminidase__InfluenzaA__ABI96131

SEQ ID NO: 15504 - protein, 470 aa, Artificial Sequence; identical to SEQ ID NO: 14386
  neuraminidase__InfluenzaA__ABI96133

SEQ ID NO: 15505 - protein, 470 aa, Artificial Sequence; identical to SEQ ID NO: 14386
  neuraminidase__InfluenzaA__ABI96136

SEQ ID NO: 15506 - protein, 469 aa, Artificial Sequence
  neuraminidase__InfluenzaA__ABJ09110
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIIHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQETEVLWTSNSIVVFCGTSGTYGTGSWPDGADINLMPI

SEQ ID NO: 15507 - protein, 469 aa, Artificial Sequence; identical to SEQ ID NO: 15101
  neuraminidase__InfluenzaA__ABJ09143

SEQ ID NO: 15508 - protein, 470 aa, Artificial Sequence; identical to SEQ ID NO: 14925
  neuraminidase__InfluenzaA__ABJ09154

SEQ ID NO: 15509 - protein, 469 aa, Artificial Sequence; identical to SEQ ID NO: 14327
  neuraminidase__InfluenzaA__ABJ09165

SEQ ID NO: 15510 - protein, 469 aa, Artificial Sequence; identical to SEQ ID NO: 14327
  neuraminidase__InfluenzaA__ABJ09176

SEQ ID NO: 15511 - protein, 469 aa, Artificial Sequence; identical to SEQ ID NO: 14714
  neuraminidase__InfluenzaA__ABJ09198

SEQ ID NO: 15512 - protein, 469 aa, Artificial Sequence; identical to SEQ ID NO: 14714
  neuraminidase__InfluenzaA__ABJ09209

SEQ ID NO: 15513 - protein, 469 aa, Artificial Sequence
  neuraminidase__InfluenzaA__ABJ09220
MNPNQKIITIGSVSLTIATICFLMQIAILVTTVTLHFKQYECNSPPNNQVMLCEPTIIERNITEIVYLTNTTIEKEICPKLAKYRNWSKPQCKITGFAPFSKDNSIRLSAGGDIWVTREPYVSCDPGKCYQFALGRGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15514 - protein, 469 aa, Artificial Sequence; identical to SEQ ID NO: 14730
  neuraminidase__InfluenzaA__ABJ09231

SEQ ID NO: 15515 - protein, 469 aa, Artificial Sequence; identical to SEQ ID NO: 14730
  neuraminidase__InfluenzaA__ABJ09242

SEQ ID NO: 15516 - protein, 469 aa, Artificial Sequence; identical to SEQ ID NO: 14284
  neuraminidase__InfluenzaA__ABJ09253

SEQ ID NO: 15517 - protein, 469 aa, Artificial Sequence
  neuraminidase__InfluenzaA__ABJ09264
MNPNQKIITIGSVSLTIATICFLMQIAILVTTVTLHFKQYECNSPPNNQVMLCEPTIIERNITEIVYMTNTTIEKEICPKLAEYRNWSKPQCNITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYNGRLVDSIGSWSKKILRTQESECVCINGTCTVVMTDGSASGKADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNSSGYSGIFSVEGKSCINRCFYVELIRGRKQETEVWWTSNSIVVLCGTSGTYGTGSWPDGADINLMPI

SEQ ID NO: 15518 - protein, 469 aa, Artificial Sequence
  neuraminidase__InfluenzaA__ABJ09286
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSPLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINKQVIVDRGNRSGYSGIFSVEGKSCINRCFYVELIRGRKQETEVLWTSNSIVVFCGTSGTYGTGSWPDGADINLMPI

SEQ ID NO: 15519 - protein, 469 aa, Artificial Sequence; identical to SEQ ID NO: 14284
  neuraminidase__InfluenzaA__ABJ09308

SEQ ID NO: 15520 - protein, 469 aa, Artificial Sequence; identical to SEQ ID NO: 15488
  neuraminidase__InfluenzaA__ABJ09319

SEQ ID NO: 15521 - protein, 470 aa, Artificial Sequence; identical to SEQ ID NO: 14953
  neuraminidase__InfluenzaA__ABJ09330

SEQ ID NO: 15522 - protein, 469 aa, Artificial Sequence
  neuraminidase__InfluenzaA__ABJ09341
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLLGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQETEVLWTSNSIVVFCGTSGTYGTGSWPDGADINLMPI

SEQ ID NO: 15523 - protein, 469 aa, Artificial Sequence
  neuraminidase__InfluenzaA__ABJ09352
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHGRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQETEVLWTSNSIVVFCGTSGTYGTGSWPDGADINLMPI

SEQ ID NO: 15524 - protein, 468 aa, Artificial Sequence
  neuraminidase__InfluenzaA__ABJ09374
MIQSKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGKKEETEVLWTSNSIVVFCGTSGTYGTGSWPDGADINLMPI

SEQ ID NO: 15525 - protein, 469 aa, Artificial Sequence; identical to SEQ ID NO: 14714
  neuraminidase__InfluenzaA__ABJ09385

SEQ ID NO: 15526 - protein, 469 aa, Artificial Sequence; identical to SEQ ID NO: 14253
  neuraminidase__InfluenzaA__ABJ16590

SEQ ID NO: 15527 - protein, 469 aa, Artificial Sequence; identical to SEQ ID NO: 15518
  neuraminidase__InfluenzaA__ABJ16601

SEQ ID NO: 15528 - protein, 470 aa, Artificial Sequence
  neuraminidase__InfluenzaA__ABJ16612
MNPNQKIITIGSISIAIGIISLMLQIGNIISIWASHSIQTGSQNHTGVCNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTVGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 15529 - protein, 469 aa, Artificial Sequence; identical to SEQ ID NO: 15518
  neuraminidase__InfluenzaA__ABJ16623

SEQ ID NO: 15530 - protein, 469 aa, Artificial Sequence
  neuraminidase__InfluenzaA__ABJ16634
MNPNQKIITIGSVSLTISTICFFMQIAILITTVTLHFKQYEFNSPPNNQVMLCEPTIIERNITEIVYLTNITIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15531 - protein, 470 aa, Artificial Sequence; identical to SEQ ID NO: 14386
  neuraminidase__InfluenzaA__ABJ16656

SEQ ID NO: 15532 - protein, 470 aa, Artificial Sequence; identical to SEQ ID NO: 14386
  neuraminidase__InfluenzaA__ABJ16667

SEQ ID NO: 15533 - protein, 470 aa, Artificial Sequence
  neuraminidase__InfluenzaA__ABJ16678
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFLVKQDVVAITDWSGYSGSFVQHPELTGLDCIRPCFWVELVRGLPRENTTIWTSGSSISFCGVDSDTANWSWPDGAELPFTIDK

SEQ ID NO: 15534 - protein, 470 aa, Artificial Sequence; identical to SEQ ID NO: 14386
  neuraminidase__InfluenzaA__ABJ16689

SEQ ID NO: 15535 - protein, 469 aa, Artificial Sequence
  neuraminidase__InfluenzaA__ABJ16700
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGKKQETEVLWTSNSIVVFCGTSGTYGTGSWPDGADINLMPI

SEQ ID NO: 15536 - protein, 469 aa, Artificial Sequence
  neuraminidase__InfluenzaA__ABJ16711
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDAWMGRTISEKLRSGYETFKVIEGWSKSNSKLQINRQVIVDRGNRSGYSGIFSVEGKSCINRCFYVELIRGRKQETEVLWTSNSIVVFCGTSGTYGTGSWPDGADINLMPI

SEQ ID NO: 15537 - protein, 470 aa, Artificial Sequence
  neuraminidase__InfluenzaA__ABJ16733
MNPNQKIITIGSISVAIGIINLILQIGNIISIWASHSIQTGSQNYTGICNQRIITYENRTWVNQTYVNINNTNVVAGKDKTSMTLAGNSSLCPIRGWAIYTKDNSIRIGSKGDIFVIREPFISCSHLECRTFFLTQGALLNDKHSNGTIKDRSPFRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 15538 - protein, 469 aa, Artificial Sequence; identical to SEQ ID NO: 14730
  neuraminidase__InfluenzaA__ABJ16744

SEQ ID NO: 15539 - protein, 469 aa, Artificial Sequence; identical to SEQ ID NO: 14730
  neuraminidase__InfluenzaA__ABJ16755

SEQ ID NO: 15540 - protein, 469 aa, Artificial Sequence; identical to SEQ ID NO: 14730
  neuraminidase__InfluenzaA__ABJ16766

SEQ ID NO: 15541 - protein, 469 aa, Artificial Sequence
  neuraminidase__InfluenzaA__ABJ16777
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15542 - protein, 469 aa, Artificial Sequence; identical to SEQ ID NO: 14730
  neuraminidase__InfluenzaA__ABJ16788

SEQ ID NO: 15543 - protein, 470 aa, Artificial Sequence; identical to SEQ ID NO: 14968
  neuraminidase__InfluenzaA__ABJ53441

SEQ ID NO: 15544 - protein, 470 aa, Artificial Sequence
  neuraminidase__InfluenzaA__ABJ53452
MNPNQKIITIGSISIAIGIISLMLQIGNIISIWASHSIQTGSQNHTGICNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 15545 - protein, 469 aa, Artificial Sequence; identical to SEQ ID NO: 14712
  neuraminidase__InfluenzaA__ABJ53463

SEQ ID NO: 15546 - protein, 469 aa, Artificial Sequence; identical to SEQ ID NO: 14712
  neuraminidase__InfluenzaA__ABJ53474

SEQ ID NO: 15547 - protein, 469 aa, Artificial Sequence
  neuraminidase__InfluenzaA__ABJ53485
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNSNSKLQTNRQVIVDRGNRSGYSGIFSVEGKSCINRCFYVELIRGRKEETEVLWTSNSIVVFCGTSGTYGTGSWPDGADINLMPI

SEQ ID NO: 15548 - protein, 470 aa, Artificial Sequence; identical to SEQ ID NO: 15356
  neuraminidase__InfluenzaA__ABJ53496

SEQ ID NO: 15549 - protein, 470 aa, Artificial Sequence; identical to SEQ ID NO: 15356
  neuraminidase__InfluenzaA__ABJ53507

SEQ ID NO: 15550 - protein, 470 aa, Artificial Sequence
  neuraminidase__InfluenzaA__ABJ53518
MNPNQKIITIGSISVAIGIINLILQIGNIISIWASHSIQTGSQNYTGICNQRIITYENRTWVNQTYVNINNTNVVAGKDKTSMTLAGNLSLCPIRGWAIYTKDNSIRIGSKGDVFVIREPFISCSHLECRTFFLTQGALLNDKHSNGTIKDRSPFRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 15551 - protein, 469 aa, Artificial Sequence; identical to SEQ ID NO: 14154
  neuraminidase__InfluenzaA__ABK39965

SEQ ID NO: 15552 - protein, 469 aa, Artificial Sequence
  neuraminidase__InfluenzaA__ABK39976
MNPNQKIITIGSVSLTISTTCFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCAVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15553 - protein, 469 aa, Artificial Sequence; identical to SEQ ID NO: 14712
  neuraminidase__InfluenzaA__ABK39987

SEQ ID NO: 15554 - protein, 469 aa, Artificial Sequence; identical to SEQ ID NO: 14382
  neuraminidase__InfluenzaA__ABK39998

SEQ ID NO: 15555 - protein, 469 aa, Artificial Sequence; identical to SEQ ID NO: 14327
  neuraminidase__InfluenzaA__ABK40020

SEQ ID NO: 15556 - protein, 470 aa, Artificial Sequence
  neuraminidase__InfluenzaA__ABK40031
MNPNQKIITIGSISVAIGIINLILQIGNIISIWASHSIQTGSQNYTGICNQRIITYENRTWVNQTYVNINNTNVVAGKDKTSMTLAGNSSLCPIRGWAIYTKDNSIRIGSKGDVFVIREPFISCSHLECRTFFLTQGALLNDKHSNGTIKDRSPFRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 15557 - protein, 470 aa, Artificial Sequence; identical to SEQ ID NO: 15556
  neuraminidase__InfluenzaA__ABK40042

SEQ ID NO: 15558 - protein, 470 aa, Artificial Sequence; identical to SEQ ID NO: 15556
  neuraminidase__InfluenzaA__ABK40053

SEQ ID NO: 15559 - protein, 469 aa, Artificial Sequence; identical to SEQ ID NO: 14730
  neuraminidase__InfluenzaA__ABK40064

SEQ ID NO: 15560 - protein, 469 aa, Artificial Sequence; identical to SEQ ID NO: 14730
  neuraminidase__InfluenzaA__ABK40078

SEQ ID NO: 15561 - protein, 470 aa, Artificial Sequence; identical to SEQ ID NO: 15059
  neuraminidase__InfluenzaA__ABK40513

SEQ ID NO: 15562 - protein, 470 aa, Artificial Sequence; identical to SEQ ID NO: 15059
  neuraminidase__InfluenzaA__ABK40538

SEQ ID NO: 15563 - protein, 470 aa, Artificial Sequence
  neuraminidase__InfluenzaA__ABK40549
MNPNQKIITIGSICMTIGIISLILQIGNIISIWVSHSIQTGSQNHTGICNQRIITYENSTWVNQTYVNINNTNVVAGKDTTSVTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSNGPASYRIFKIEKGKITKSIELDAPNSHYEECSCYPDTGTVMCVCRDNWHGSNRPWVSFNQNLDYKIGYICSGVFGDNPRPKDGKGSCDPVTVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTANWSWPDGAELPFTIDK

SEQ ID NO: 15564 - protein, 470 aa, Artificial Sequence; identical to SEQ ID NO: 15059
  neuraminidase__InfluenzaA__ABK40560

SEQ ID NO: 15565 - protein, 470 aa, Artificial Sequence; identical to SEQ ID NO: 15059
  neuraminidase__InfluenzaA__ABK40571

SEQ ID NO: 15566 - protein, 470 aa, Artificial Sequence; identical to SEQ ID NO: 15059
  neuraminidase__InfluenzaA__ABK40582

SEQ ID NO: 15567 - protein, 470 aa, Artificial Sequence
  neuraminidase__InfluenzaA__ABK40593
MNPNQKIITIGSICMTIGIISLILQIGNIISIWVSHSIQTGSQNHTGICNQRIITYENSTWVNQTYVNINNTNVVAGKDTTSVTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSNGPASHRIFKIEKGKITKSIELDAPNSHYEECSCYPDTGTVMCVCRDNWHGSNRPWVSFNQNLDYKIGYICSGVFGDNPRPKDGKGSCDPVTVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTANWSWPDGAELPFTIDK

SEQ ID NO: 15568 - protein, 470 aa, Artificial Sequence; identical to SEQ ID NO: 15059
  neuraminidase__InfluenzaA__ABK40604

SEQ ID NO: 15569 - protein, 469 aa, Artificial Sequence; identical to SEQ ID NO: 14730
  neuraminidase__InfluenzaA__ABK40615

SEQ ID NO: 15570 - protein, 469 aa, Artificial Sequence; identical to SEQ ID NO: 14061
  neuraminidase__InfluenzaA__ABK40626

SEQ ID NO: 15571 - protein, 469 aa, Artificial Sequence
  neuraminidase__InfluenzaA__ABK40648
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGIPFHLGTKQVCIAWSSSSCHDGKAWLHVCVTGHDENATASFIYDGRLVDSIGSWSKNILRTQESECVCINGTCTVVMTDGSASDRADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEESRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 15572 - protein, 469 aa, Artificial Sequence; identical to SEQ ID NO: 15113
  neuraminidase__InfluenzaA__ABK40659

SEQ ID NO: 15573 - protein, 469 aa, Artificial Sequence; identical to SEQ ID NO: 15101
  neuraminidase__InfluenzaA__ABK40681

SEQ ID NO: 15574 - protein, 470 aa, Artificial Sequence
  neuraminidase__InfluenzaA__ABK40692
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWEKRILRTQESECVCVNGSCFTIMTDGPSNGAASYKIFKIEKGKVTKSVELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 15575 - protein, 469 aa, Artificial Sequence; identical to SEQ ID NO: 14730
  neuraminidase__InfluenzaA__ABK40703

SEQ ID NO: 15576 - protein, 469 aa, Artificial Sequence; identical to SEQ ID NO: 14730
  neuraminidase__InfluenzaA__ABK40714

SEQ ID NO: 15577 - protein, 469 aa, Artificial Sequence; identical to SEQ ID NO: 14730
  neuraminidase__InfluenzaA__ABK40725

SEQ ID NO: 15578 - protein, 469 aa, Artificial Sequence; identical to SEQ ID NO: 14730
  neuraminidase__InfluenzaA__ABK40736

SEQ ID NO: 15579 - protein, 469 aa, Artificial Sequence; identical to SEQ ID NO: 15445
  neuraminidase__InfluenzaA__ABK40747

SEQ ID NO: 15580 - protein, 470 aa, Artificial Sequence; identical to SEQ ID NO: 14951
  neuraminidase__InfluenzaA__ABK79951

SEQ ID NO: 15581 - protein, 470 aa, Artificial Sequence; identical to SEQ ID NO: 15556
  neuraminidase__InfluenzaA__ABK79973

SEQ ID NO: 15582 - protein, 469 aa, Artificial Sequence; identical to SEQ ID NO: 14730
  neuraminidase__InfluenzaA__ABK79984

SEQ ID NO: 15583 - protein, 469 aa, Artificial Sequence; identical to SEQ ID NO: 14730
  neuraminidase__InfluenzaA__ABK79995

SEQ ID NO: 15584 - protein, 470 aa, Artificial Sequence; identical to SEQ ID NO: 15059
  neuraminidase__InfluenzaA__ABK80028

SEQ ID NO: 15585 - protein, 470 aa, Artificial Sequence; identical to SEQ ID NO: 15059
  neuraminidase__InfluenzaA__ABK80039

SEQ ID NO: 15586 - protein, 470 aa, Artificial Sequence; identical to SEQ ID NO: 15059
  neuraminidase__InfluenzaA__ABK80050

SEQ ID NO: 15587 - protein, 469 aa, Artificial Sequence
  neuraminidase__InfluenzaA__ABK80061
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15588 - protein, 469 aa, Artificial Sequence; identical to SEQ ID NO: 14061
  neuraminidase__InfluenzaA__ABK80072

SEQ ID NO: 15589 - protein, 469 aa, Artificial Sequence
  neuraminidase__InfluenzaA__ABK80083
MNPNQKIITIGSVSLTIATICFLMQIAILVTTVTLHFKQYECSSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15590 - protein, 469 aa, Artificial Sequence
  neuraminidase__InfluenzaA__ABK80094
MNPNQKIITIGSVSLIIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQETEVLWTSNSIVVFCGTSGTYGTGSWPDGADINLMPI

SEQ ID NO: 15591 - protein, 469 aa, Artificial Sequence; identical to SEQ ID NO: 14730
  neuraminidase__InfluenzaA__ABK80105

SEQ ID NO: 15592 - protein, 469 aa, Artificial Sequence
  neuraminidase__InfluenzaA__ABK80138
MNPNQKIITIGSVSLTIATICFLMQTAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15593 - protein, 469 aa, Artificial Sequence
  neuraminidase__InfluenzaA__ABK80149
MNPNQKIITIGSVSLTIATICFLMQIAILVTTVTLHFKQYECNSPPNNQAMLYEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15594 - protein, 469 aa, Artificial Sequence; identical to SEQ ID NO: 15593
  neuraminidase__InfluenzaA__ABK80160

SEQ ID NO: 15595 - protein, 469 aa, Artificial Sequence
  neuraminidase__InfluenzaA__ABK80171
MNPNQKIITIGSVSLTIATICFLMQIAILVTTVTLHFKQYECNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIFSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15596 - protein, 469 aa, Artificial Sequence
  neuraminidase__InfluenzaA__ABK80182
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGKLVDSIGSWSKKILRTQESECVCINGTCAVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15597 - protein, 469 aa, Artificial Sequence
  neuraminidase__InfluenzaA__ABK80193
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTIGEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15598 - protein, 469 aa, Artificial Sequence
  neuraminidase__InfluenzaA__ABK80204
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGKLVDSIGSWSKKILRTQESECVCINGTCAVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDAWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15599 - protein, 469 aa, Artificial Sequence; identical to SEQ ID NO: 14591
  neuraminidase__InfluenzaA__ABK80215

SEQ ID NO: 15600 - protein, 469 aa, Artificial Sequence; identical to SEQ ID NO: 14591
  neuraminidase__InfluenzaA__ABK80226

SEQ ID NO: 15601 - protein, 469 aa, Artificial Sequence
  neuraminidase__InfluenzaA__ABK80237
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKTDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15602 - protein, 469 aa, Artificial Sequence
  neuraminidase__InfluenzaA__ABK80259
MNPNQKIITIGSASLTIATICFLIQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSISSWSKKILRTQESECVCINGTCTVVMTDGSASGKADTKILFIEEGKIIHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSNPNSKLQINRQVIVERGNRSGYSGIFSVEGKSCINRCFYVELIRGRKEETEVWWTSNSIVVFCGTSGTYGTGSWPDGADINLMPI

SEQ ID NO: 15603 - protein, 469 aa, Artificial Sequence; identical to SEQ ID NO: 14327
  neuraminidase__InfluenzaA__ABK80270

SEQ ID NO: 15604 - protein, 469 aa, Artificial Sequence; identical to SEQ ID NO: 14714
  neuraminidase__InfluenzaA__ABK80281

SEQ ID NO: 15605 - protein, 469 aa, Artificial Sequence
  neuraminidase__InfluenzaA__ABK80292
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIIHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRSNRSGYSGIFSVEGKSCINRCFYVELIRGRKEETEVLWTSNSIVVFCGTSGTYGTGSWPDGADINLMPI

SEQ ID NO: 15606 - protein, 469 aa, Artificial Sequence
  neuraminidase__InfluenzaA__ABK80303
MNPNQKIITIGSVSLTIATICFLMQIAILVTTVTLHFKQYECNSPPNNQVMLYEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGNASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15607 - protein, 469 aa, Artificial Sequence
  neuraminidase__InfluenzaA__ABK80314
MNPNQKIITIGSVSLTIATICFLMQIAILVTTVTLHFKQYECDSPPNNQVMLYEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15608 - protein, 449 aa, Artificial Sequence
  neuraminidase__InfluenzaA__ABL07021
MNPNQKIITIGSICMVIGIVSLMLQIGNMISIWVSHSIQKGNQHQAESISNTNPLTEKAVASITLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMKKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15609 - protein, 449 aa, Artificial Sequence
  neuraminidase__InfluenzaA__ABL07032
MNPNQKIITIGSICMVIGIVSLMLQIGNMVSTWVSHSIQTGNQYQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15610 - protein, 449 aa, Artificial Sequence
  neuraminidase__InfluenzaA__ABL31746
MNPNQKIITIGSICMVIGIVSLMLQIGNMISIWVSHSIQTGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGNSWLTIGISGPDNEAVAVLKYNGIITDTIKSWRKNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15611 - protein, 449 aa, Artificial Sequence
  neuraminidase__InfluenzaA__ABL31757
MNPNQKIITIGSICMVIGIVSLMLQIGNMISIWVSHSIQTGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15612 - protein, 449 aa, Artificial Sequence; identical to SEQ ID NO: 15611
  neuraminidase__InfluenzaA__ABL31768

SEQ ID NO: 15613 - protein, 469 aa, Artificial Sequence; identical to SEQ ID NO: 14591
  neuraminidase__InfluenzaA__ABL67168

SEQ ID NO: 15614 - protein, 469 aa, Artificial Sequence; identical to SEQ ID NO: 14730
  neuraminidase__InfluenzaA__ABL67179

SEQ ID NO: 15615 - protein, 470 aa, Artificial Sequence; identical to SEQ ID NO: 15556
  neuraminidase__InfluenzaA__ABL67190

SEQ ID NO: 15616 - protein, 469 aa, Artificial Sequence
  neuraminidase__InfluenzaA__ABL67201
MNPNQKIITISSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15617 - protein, 470 aa, Artificial Sequence; identical to SEQ ID NO: 15556
  neuraminidase__InfluenzaA__ABL67212

SEQ ID NO: 15618 - protein, 470 aa, Artificial Sequence; identical to SEQ ID NO: 15059
  neuraminidase__InfluenzaA__ABL67256

SEQ ID NO: 15619 - protein, 470 aa, Artificial Sequence; identical to SEQ ID NO: 15059
  neuraminidase__InfluenzaA__ABL67267

SEQ ID NO: 15620 - protein, 469 aa, Artificial Sequence; identical to SEQ ID NO: 14061
  neuraminidase__InfluenzaA__ABL67278

SEQ ID NO: 15621 - protein, 469 aa, Artificial Sequence
  neuraminidase__InfluenzaA__ABL67289
MNPNQKIITIGSVSLTIATICFLMQIAILVTTVTLHFKQYECNSPPNNQVMLYEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15622 - protein, 469 aa, Artificial Sequence
  neuraminidase__InfluenzaA__ABL67300
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKNILRTQESECVCINGTCTVVMTDGSASGKADTKILFIEEGKIVHISTLSGSAQHVEECSCYPRYPGVRCVCRDNWKGSNRPIVDINVKDHSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15623 - protein, 469 aa, Artificial Sequence; identical to SEQ ID NO: 14180
  neuraminidase__InfluenzaA__ABL67311

SEQ ID NO: 15624 - protein, 469 aa, Artificial Sequence
  neuraminidase__InfluenzaA__ABL67322
MNPNQKIITIGSVSLTIATICFLMQIAILVTTVTLHFKQYECNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHTSTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15625 - protein, 469 aa, Artificial Sequence
  neuraminidase__InfluenzaA__ABL67333
MNPNQKIITIGSVSLTIATICFLMQIAILVITVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGKLVDSIGSWSKKILRTQESECVCINGTCAVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15626 - protein, 469 aa, Artificial Sequence; identical to SEQ ID NO: 14591
  neuraminidase__InfluenzaA__ABL67344

SEQ ID NO: 15627 - protein, 469 aa, Artificial Sequence
  neuraminidase__InfluenzaA__ABL67355
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPEKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15628 - protein, 469 aa, Artificial Sequence
  neuraminidase__InfluenzaA__ABL67366
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTRILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15629 - protein, 469 aa, Artificial Sequence
  neuraminidase__InfluenzaA__ABL67377
MNPNQKIITIGSASLTIAIICFLIQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSISSWSKKILRTQESECVCINGTCTVVMTDGSASGKADTKILFIEEGKIIHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSNPNSKLQINRQVIVERGNRSGYSGIFSVEGKSCINRCFYVELIRGRKEETEVWWTSNSIVVFCGTSGTYGTGSWPDGADLNLMPI

SEQ ID NO: 15630 - protein, 469 aa, Artificial Sequence; identical to SEQ ID NO: 14327
  neuraminidase__InfluenzaA__ABL67388

SEQ ID NO: 15631 - protein, 469 aa, Artificial Sequence; identical to SEQ ID NO: 14327
  neuraminidase__InfluenzaA__ABL67399

SEQ ID NO: 15632 - protein, 469 aa, Artificial Sequence; identical to SEQ ID NO: 14712
  neuraminidase__InfluenzaA__ABL67410

SEQ ID NO: 15633 - protein, 469 aa, Artificial Sequence
  neuraminidase__InfluenzaA__ABL67421
MNPNQKIITIGSISLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15634 - protein, 449 aa, Artificial Sequence
  neuraminidase__InfluenzaA__ABL67772
MNPNKKIITIGSICMVTGMVSLMLQIGNLISIWVSHSIHTGNQHKAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLKYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15635 - protein, 449 aa, Artificial Sequence
  neuraminidase__InfluenzaA__ABL67783
MNPNKKIITIGSICMVTGMVSLMLQIGNLISIWVSHSIHTGNQHKAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDSGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15636 - protein, 449 aa, Artificial Sequence
  neuraminidase__InfluenzaA__ABL67796
MNPNKKIITIGSICMVTGMVSLMLQIGNLISIWVSHSIHTGNQHKAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSYNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15637 - protein, 449 aa, Artificial Sequence
  neuraminidase__InfluenzaA__ABL67807
MNPNKKIITIGSICMVTGMVSLMLQIGNLISIWVSHSIHTGNQHKAEPISNTNLLTEKAVASVKLAGNSSLCPIDGWAVYSKDNSIRIGSKGDVFVVREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGAGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15638 - protein, 449 aa, Artificial Sequence
  neuraminidase__InfluenzaA__ABL67818
MNPNKKIITIGSICMVTGMVSLMLQIGNLISIWVSHSIHTGNQHKAEPISNTNLLTEKAVASVKLAGNSSLCPIDGWAVYSKDNSIRIGSKGDVFVVREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGYCFTVMTDGPSNGQASHKIFKMEKGKVVKSVELDAPNYHYEECSCYPDAGEITCVCRDNWHGSNRPWVSFNQNLEYQIGYICSGVFGDNPRPNDGAGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15639 - protein, 449 aa, Artificial Sequence
  neuraminidase__InfluenzaA__ABL67829
MNPNKKIITIGSICMVTGMVSLMLQIGNLISIWVSHSIHTGNQHKAEPISNTNLLTEKAVASVKLAGNSSLCPINGWAVYSKDNSIRIGSKGDVFVVREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGFCFTVMTDGPSNGQASHKIFKMEKGKVVKSVELDAPNYHYEECSCYPDAGEITCVCRDNWHGSNRPWVSFNQNLEYQIGYICSGVFGDNPRPNDGAGSCGPVASNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 15640 - protein, 469 aa, Artificial Sequence; identical to SEQ ID NO: 14712
  neuraminidase__InfluenzaA__ABM22018

SEQ ID NO: 15641 - protein, 470 aa, Artificial Sequence; identical to SEQ ID NO: 15556
  neuraminidase__InfluenzaA__ABM22029

SEQ ID NO: 15642 - protein, 469 aa, Artificial Sequence; identical to SEQ ID NO: 14714
  neuraminidase__InfluenzaA__ABM22040

SEQ ID NO: 15643 - protein, 469 aa, Artificial Sequence; identical to SEQ ID NO: 15621
  neuraminidase__InfluenzaA__ABM22062

SEQ ID NO: 15644 - protein, 469 aa, Artificial Sequence
  neuraminidase__InfluenzaA__ABM22073
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFNLGTRQVCIAWSSSSCHDGKAWLHVCVTGDDENATASFIYNGKLVDSIGSWSKKILRTQESECVCINGTCAVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15645 - protein, 469 aa, Artificial Sequence; identical to SEQ ID NO: 14591
  neuraminidase__InfluenzaA__ABM22084

SEQ ID NO: 15646 - protein, 469 aa, Artificial Sequence
  neuraminidase__InfluenzaA__ABM22095
MNPNQKIITIGSVSLTIATICFLMQIAILVTTVTLHFKQHECNSPPNNQAMLCEPTIIERNITEIVHLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15647 - protein, 469 aa, Artificial Sequence; identical to SEQ ID NO: 14591
  neuraminidase__InfluenzaA__ABM22106

SEQ ID NO: 15648 - protein, 469 aa, Artificial Sequence; identical to SEQ ID NO: 14591
  neuraminidase__InfluenzaA__ABM22117

SEQ ID NO: 15649 - protein, 469 aa, Artificial Sequence; identical to SEQ ID NO: 15602
  neuraminidase__InfluenzaA__ABM22128

SEQ ID NO: 15650 - protein, 469 aa, Artificial Sequence
  neuraminidase__InfluenzaA__ABM22139
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASEKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15651 - protein, 469 aa, Artificial Sequence
  neuraminidase__InfluenzaA__ABM22150
MNPNQKIITIGSVSLTISTICFFMQIAILITTVTLHFKQYEFNSLPNNQVMLCEPTIIERNITEIVYLTNTTIEKEICPELAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15652 - protein, 470 aa, Artificial Sequence; identical to SEQ ID NO: 15059
  neuraminidase__InfluenzaA__ABM22161

SEQ ID NO: 15653 - protein, 470 aa, Artificial Sequence; identical to SEQ ID NO: 15059
  neuraminidase__InfluenzaA__ABM22172

SEQ ID NO: 15654 - protein, 470 aa, Artificial Sequence; identical to SEQ ID NO: 15059
  neuraminidase__InfluenzaA__ABM22183

SEQ ID NO: 15655 - protein, 470 aa, Artificial Sequence; identical to SEQ ID NO: 15059
  neuraminidase__InfluenzaA__ABM22194

SEQ ID NO: 15656 - protein, 470 aa, Artificial Sequence; identical to SEQ ID NO: 15059
  neuraminidase__InfluenzaA__ABM22205

SEQ ID NO: 15657 - protein, 470 aa, Artificial Sequence; identical to SEQ ID NO: 15059
  neuraminidase__InfluenzaA__ABM22216

SEQ ID NO: 15658 - protein, 470 aa, Artificial Sequence; identical to SEQ ID NO: 15059
  neuraminidase__InfluenzaA__ABM22227

SEQ ID NO: 15659 - protein, 470 aa, Artificial Sequence; identical to SEQ ID NO: 15059
  neuraminidase__InfluenzaA__ABM22238

SEQ ID NO: 15660 - protein, 470 aa, Artificial Sequence
  neuraminidase__InfluenzaA__ABM22271
MNPNQKIITIGSISIVIGIISLILQIGNIISIWASHSIQTGSQNHTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGRVTKSIELGAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 15661 - protein, 470 aa, Artificial Sequence; identical to SEQ ID NO: 14968
  neuraminidase__InfluenzaA__ABM22282

SEQ ID NO: 15662 - protein, 469 aa, Artificial Sequence; identical to SEQ ID NO: 14343
  neuraminidase__InfluenzaA__ABM22304

SEQ ID NO: 15663 - protein, 469 aa, Artificial Sequence; identical to SEQ ID NO: 14343
  neuraminidase__InfluenzaA__ABM22315

SEQ ID NO: 15664 - protein, 469 aa, Artificial Sequence; identical to SEQ ID NO: 14343
  neuraminidase__InfluenzaA__ABM22326

SEQ ID NO: 15665 - protein, 469 aa, Artificial Sequence; identical to SEQ ID NO: 14343
  neuraminidase__InfluenzaA__ABM22337

SEQ ID NO: 15666 - protein, 469 aa, Artificial Sequence; identical to SEQ ID NO: 14346
  neuraminidase__InfluenzaA__ABM22348

SEQ ID NO: 15667 - protein, 469 aa, Artificial Sequence; identical to SEQ ID NO: 14346
  neuraminidase__InfluenzaA__ABM22359

SEQ ID NO: 15668 - protein, 469 aa, Artificial Sequence; identical to SEQ ID NO: 14346
  neuraminidase__InfluenzaA__ABM22370

SEQ ID NO: 15669 - protein, 470 aa, Artificial Sequence; identical to SEQ ID NO: 14925
  neuraminidase__InfluenzaA__ABM66867

SEQ ID NO: 15670 - protein, 470 aa, Artificial Sequence; identical to SEQ ID NO: 15059
  neuraminidase__InfluenzaA__ABM66900

SEQ ID NO: 15671 - protein, 470 aa, Artificial Sequence; identical to SEQ ID NO: 15059
  neuraminidase__InfluenzaA__ABM66911

SEQ ID NO: 15672 - protein, 469 aa, Artificial Sequence; identical to SEQ ID NO: 14346
  neuraminidase__InfluenzaA__ABM66922

SEQ ID NO: 15673 - protein, 469 aa, Artificial Sequence; identical to SEQ ID NO: 14346
  neuraminidase__InfluenzaA__ABM66933

SEQ ID NO: 15674 - protein, 469 aa, Artificial Sequence; identical to SEQ ID NO: 14346
  neuraminidase__InfluenzaA__ABM66944

SEQ ID NO: 15675 - protein, 469 aa, Artificial Sequence; identical to SEQ ID NO: 14346
  neuraminidase__InfluenzaA__ABM66955

SEQ ID NO: 15676 - protein, 469 aa, Artificial Sequence; identical to SEQ ID NO: 14346
  neuraminidase__InfluenzaA__ABM66966

SEQ ID NO: 15677 - protein, 469 aa, Artificial Sequence; identical to SEQ ID NO: 14346
  neuraminidase__InfluenzaA__ABM66977

SEQ ID NO: 15678 - protein, 469 aa, Artificial Sequence; identical to SEQ ID NO: 14346
  neuraminidase__InfluenzaA__ABM66988

SEQ ID NO: 15679 - protein, 469 aa, Artificial Sequence; identical to SEQ ID NO: 14346
  neuraminidase__InfluenzaA__ABM66999

SEQ ID NO: 15680 - protein, 469 aa, Artificial Sequence; identical to SEQ ID NO: 14346
  neuraminidase__InfluenzaA__ABM67010

SEQ ID NO: 15681 - protein, 469 aa, Artificial Sequence; identical to SEQ ID NO: 14346
  neuraminidase__InfluenzaA__ABM67021

SEQ ID NO: 15682 - protein, 470 aa, Artificial Sequence
  neuraminidase__InfluenzaA__ABM67054
MNPNQKIITIGSISIAIGTISLMLQIGNMISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 15683 - protein, 449 aa, Artificial Sequence
  neuraminidase__InfluenzaA__ABM68048
MNPNQKIITIGSICMVIGIVSLMLQIGNIISIWISHSIQTGNQCQAGPISNTKFLTEKAVASVTLAGNSSLCPISGWAVYSKDNSIRIGSRGDVFVIRESFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDSWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15684 - protein, 449 aa, Artificial Sequence
  neuraminidase__InfluenzaA__ABM68049
MNPNQKIITIGSICMVIGIVSLMLQIGNIISIWISHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDSWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15685 - protein, 449 aa, Artificial Sequence
  neuraminidase__InfluenzaA__ABM90436
MNPNQKIITIGSICMVIGIVSLMLQIGNMISIWVSHSIQKGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMKKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15686 - protein, 449 aa, Artificial Sequence; identical to SEQ ID NO: 15685
  neuraminidase__InfluenzaA__ABM90447

SEQ ID NO: 15687 - protein, 449 aa, Artificial Sequence; identical to SEQ ID NO: 15685
  neuraminidase__InfluenzaA__ABM90458

SEQ ID NO: 15688 - protein, 449 aa, Artificial Sequence; identical to SEQ ID NO: 15685
  neuraminidase__InfluenzaA__ABM90469

SEQ ID NO: 15689 - protein, 449 aa, Artificial Sequence
  neuraminidase__InfluenzaA__ABM90491
MNPNQKIITIGSICMVIGIVSLMLQIGNMISIWVSHSIQKGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMKKGKVIKSVELDATNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15690 - protein, 449 aa, Artificial Sequence; identical to SEQ ID NO: 15689
  neuraminidase__InfluenzaA__ABM90502

SEQ ID NO: 15691 - protein, 449 aa, Artificial Sequence
  neuraminidase__InfluenzaA__ABM90524
MNPNQKIITIGSICMVIGIVSLMLQIGNMISIWVSHSIQTGNQHQAESISNTNPLTEKAVVSVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 15692 - protein, 449 aa, Artificial Sequence; identical to SEQ ID NO: 15691
  neuraminidase__InfluenzaA__ABM90535

SEQ ID NO: 15693 - protein, 449 aa, Artificial Sequence; identical to SEQ ID NO: 15691
  neuraminidase__InfluenzaA__ABM90546

SEQ ID NO: 15694 - protein, 470 aa, Artificial Sequence
  neuraminidase__InfluenzaA__ABN50759
MNPNQKIITIGSICMAIGIISLILQIGNIISIWVSHSIQTGSQNHTGICNQRIITYENSTWVNQTYVNISNTNVVAGKDTTSMTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKQILRTQESECVCVNGSCFTIMTDGPSDGQASYRIFKIEKGKITKSIELDAPNSHYEECSCYPDTGTVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDSNFLVKQDVVAMTDWSGYSGSFVQHPELTGLDCIRPCFWVELIRGRPREKTTIWTSGSSISFCGVNSDTVNWSWPDGAELPFTIDK

SEQ ID NO: 15695 - protein, 469 aa, Artificial Sequence
  neuraminidase__InfluenzaA__ABN50770
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSVVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15696 - protein, 470 aa, Artificial Sequence
  neuraminidase__InfluenzaA__ABN50903
MNPNQKIITIGSICMAIGIISLILQIGNIISIWVSHSIQTGSQNHTGICNQRIITYENSTWVNQTYVNINNTNVVAGKDTTSVTLAGNSSLCPVRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSNGPASYRIFKIEKGKITKSIELDAPNSHYEECSCYPDTGTVMCVCRDNWHGSNRPWVSFNQNLDYQIGYICSGVFGDNPRPKDGKGSCGPVTVDGADGVKGFSYRYGNGVWIGRTKSNSSRKGFEMIWDPNGWTDTDSNFLVKQDVVAMTDWSGYSGSFIQHPELTGLDCMRPCFWVELIRGRPREKTTIWTSGSSISFCGVNSDTVNWSWPDGAELPFTIDK

SEQ ID NO: 15697 - protein, 470 aa, Artificial Sequence; identical to SEQ ID NO: 15059
  neuraminidase__InfluenzaA__ABN50920

SEQ ID NO: 15698 - protein, 470 aa, Artificial Sequence
  neuraminidase__InfluenzaA__ABN50931
MNPNQKIITIGSICMAIGIISLILQIGNIVSIWISHSIQTGSQNYTGICNQRIITYENSTWVNQTYVNINNTNVVAGQDTTSVALAGNSSLCPISGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPNNGPASYKIFKIEKGKITKSIELDAPNSHYEECSCYPDAGTVMCVCRDNWHGSNRPWVSFNQNLDYQIGYICSGVFGDNPRPKDGKGSCGPVTVDGADGVKGFSYRYGNGVWIGRTKSNSSRRGFEMIWDPNGWTDTDSKFLVKQDVVAITDWSGYSGSFVQHPELTGLDCMRPCFWVELIRGRPRENTTIWTSGSSISFCGVNGDTANWSWPDGAELPFTIDK

SEQ ID NO: 15699 - protein, 470 aa, Artificial Sequence
  neuraminidase__InfluenzaA__ABN50943
MNPNQKIITIGSICMAIGIISLILQIGNIVSIWISHSIQTGSQNYTGICNQRIITYENSTWVNQTYVNINNTNVVAGQDTTSVALAGNSSLCPISGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPNNGPASYKIFKIEKGKITKSIELDAPNSHYEECSCYPDAGTVMCVCRDNWHGSNRPWVSFNQNLDYQIGYICSGVFGDNPRPKDGKGSCGPVTVDGADGVKGFSYRYGNGVWIGRTKSNSSRRGFEMIWDPNGWTDTDSKFLVKQDVVAMTDWSGYSGSFVQHPELTGLDCMRPCFWVELIRGRPRENTTIWTSGSSISFCGVNGDTANWSWPDGAELPFTIDK

SEQ ID NO: 15700 - protein, 470 aa, Artificial Sequence; identical to SEQ ID NO: 14968
  neuraminidase__InfluenzaA__ABN50954

SEQ ID NO: 15701 - protein, 470 aa, Artificial Sequence; identical to SEQ ID NO: 14968
  neuraminidase__InfluenzaA__ABN50965

SEQ ID NO: 15702 - protein, 470 aa, Artificial Sequence; identical to SEQ ID NO: 14968
  neuraminidase__InfluenzaA__ABN50976

SEQ ID NO: 15703 - protein, 469 aa, Artificial Sequence; identical to SEQ ID NO: 14343
  neuraminidase__InfluenzaA__ABN50987

SEQ ID NO: 15704 - protein, 469 aa, Artificial Sequence; identical to SEQ ID NO: 14346
  neuraminidase__InfluenzaA__ABN50998

SEQ ID NO: 15705 - protein, 469 aa, Artificial Sequence
  neuraminidase__InfluenzaA__ABN51013
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSLCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15706 - protein, 469 aa, Artificial Sequence
  neuraminidase__InfluenzaA__ABN51024
MNPNQKIITIGSVSLTVSTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 15707 - protein, 469 aa, Artificial Sequence
  neuraminidase__InfluenzaA__ABN51035
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKNYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15708 - protein, 469 aa, Artificial Sequence; identical to SEQ ID NO: 15707
  neuraminidase__InfluenzaA__ABN51046

SEQ ID NO: 15709 - protein, 470 aa, Artificial Sequence
  neuraminidase__InfluenzaA__ABN51069
MNPNQKIITIGSISIAIGIISLILQIGNIISIWASHSIQTGSQNHTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMVWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 15710 - protein, 470 aa, Artificial Sequence
  neuraminidase__InfluenzaA__ABN51080
MNPNQKIITIGSISIAIGIISLMLQIGNIISIWASHSIQTGSQNHTGVCNQRIITYENSTWVNHTYVNINNTNVIAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSVELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 15711 - protein, 470 aa, Artificial Sequence; identical to SEQ ID NO: 14386
  neuraminidase__InfluenzaA__ABN51091

SEQ ID NO: 15712 - protein, 469 aa, Artificial Sequence; identical to SEQ ID NO: 14095
  neuraminidase__InfluenzaA__ABN51102

SEQ ID NO: 15713 - protein, 469 aa, Artificial Sequence; identical to SEQ ID NO: 14103
  neuraminidase__InfluenzaA__ABN51113

SEQ ID NO: 15714 - protein, 469 aa, Artificial Sequence
  neuraminidase__InfluenzaA__ABN51124
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRVPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 15715 - protein, 469 aa, Artificial Sequence; identical to SEQ ID NO: 14103
  neuraminidase__InfluenzaA__ABN51135

SEQ ID NO: 15716 - protein, 470 aa, Artificial Sequence; identical to SEQ ID NO: 14396
  neuraminidase__InfluenzaA__ABN51146

SEQ ID NO: 15717 - protein, 469 aa, Artificial Sequence
  neuraminidase__InfluenzaA__ABN51157
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKAETKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15718 - protein, 469 aa, Artificial Sequence; identical to SEQ ID NO: 15706
  neuraminidase__InfluenzaA__ABN59393

SEQ ID NO: 15719 - protein, 454 aa, Artificial Sequence
  neuraminidase__InfluenzaA__ABN59415
MNPNQKIITIGSICLVVGLISLILQIGNIISIWISHSIQTGSQNHTGICNQNIITYKNSTWVKDTTSVILTGNSSLCPIRGWAIYSKDNSIRIGSKGDVFVIREPFISCSHLECRTFFLTQGALLNDKHSSGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSDGLASYKIFKIEKGKVTKSIELNAPNSHYEECSCYPDTGKVMCVCRDNWHGSNRPWVSFDQNLDYQIGYICSGVFGDNPRPEDGTGSCGPVYVDGANGVKGFSYRYGNGVWIGRTKSHSSRHGFEMIWDPNGWTETDSKFSVRQDVVAMTDWSGYSGSFVQHPELTGLDCMRPCFWVELIRGRPKEKTIWTSASSISFCGVNSDTVDWSWPDGAELPFSIDK

SEQ ID NO: 15720 - protein, 470 aa, Artificial Sequence; identical to SEQ ID NO: 14951
  neuraminidase__InfluenzaA__ABN59426

SEQ ID NO: 15721 - protein, 469 aa, Artificial Sequence; identical to SEQ ID NO: 14253
  neuraminidase__InfluenzaA__ABO32659

SEQ ID NO: 15722 - protein, 469 aa, Artificial Sequence
  neuraminidase__InfluenzaA__ABO32670
MNPNQKIITIGSVSLTISTICFFMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHMGTKQVCIAWSSSSCHDGKAWLHVCVTGDDENATASFIYNGRLVDSIGSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15723 - protein, 470 aa, Artificial Sequence; identical to SEQ ID NO: 15574
  neuraminidase__InfluenzaA__ABO32681

SEQ ID NO: 15724 - protein, 469 aa, Artificial Sequence
  neuraminidase__InfluenzaA__ABO32695
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCSDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15725 - protein, 469 aa, Artificial Sequence; identical to SEQ ID NO: 14730
  neuraminidase__InfluenzaA__ABO32754

SEQ ID NO: 15726 - protein, 469 aa, Artificial Sequence; identical to SEQ ID NO: 14730
  neuraminidase__InfluenzaA__ABO32765

SEQ ID NO: 15727 - protein, 469 aa, Artificial Sequence; identical to SEQ ID NO: 15602
  neuraminidase__InfluenzaA__ABO32778

SEQ ID NO: 15728 - protein, 469 aa, Artificial Sequence
  neuraminidase__InfluenzaA__ABO32793
MNPNQKIITIGSVSLTISTICFFMQIVILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKTDTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15729 - protein, 469 aa, Artificial Sequence; identical to SEQ ID NO: 14327
  neuraminidase__InfluenzaA__ABO32806

SEQ ID NO: 15730 - protein, 469 aa, Artificial Sequence; identical to SEQ ID NO: 14714
  neuraminidase__InfluenzaA__ABO32819

SEQ ID NO: 15731 - protein, 469 aa, Artificial Sequence; identical to SEQ ID NO: 14346
  neuraminidase__InfluenzaA__ABO32830

SEQ ID NO: 15732 - protein, 469 aa, Artificial Sequence; identical to SEQ ID NO: 14712
  neuraminidase__InfluenzaA__ABO32841

SEQ ID NO: 15733 - protein, 469 aa, Artificial Sequence; identical to SEQ ID NO: 14712
  neuraminidase__InfluenzaA__ABO32852

SEQ ID NO: 15734 - protein, 469 aa, Artificial Sequence; identical to SEQ ID NO: 14712
  neuraminidase__InfluenzaA__ABO32863

SEQ ID NO: 15735 - protein, 469 aa, Artificial Sequence; identical to SEQ ID NO: 15706
  neuraminidase__InfluenzaA__ABO32874

SEQ ID NO: 15736 - protein, 469 aa, Artificial Sequence; identical to SEQ ID NO: 15706
  neuraminidase__InfluenzaA__ABO32885

SEQ ID NO: 15737 - protein, 469 aa, Artificial Sequence; identical to SEQ ID NO: 15707
  neuraminidase__InfluenzaA__ABO32896

SEQ ID NO: 15738 - protein, 469 aa, Artificial Sequence; identical to SEQ ID NO: 15707
  neuraminidase__InfluenzaA__ABO32907

SEQ ID NO: 15739 - protein, 469 aa, Artificial Sequence
  neuraminidase__InfluenzaA__ABO32918
MNPNQKIITIGSVSLTISTICFFMQIAILITTVTLHFKQYEFNSPPNNQVMLCEPTIIERNITEIVYLTNTTIEKETCPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNSNSKLQTNRQVIVDRGNRSGYSGIFSVEGKSCINRCFYVELIRGRKEETEVLWTSNSIVVFCGTSGTYGTGSWPDGADINLMPI

SEQ ID NO: 15740 - protein, 469 aa, Artificial Sequence; identical to SEQ ID NO: 15739
  neuraminidase__InfluenzaA__ABO32929

SEQ ID NO: 15741 - protein, 469 aa, Artificial Sequence; identical to SEQ ID NO: 15739
  neuraminidase__InfluenzaA__ABO32940

SEQ ID NO: 15742 - protein, 470 aa, Artificial Sequence
  neuraminidase__InfluenzaA__ABO32951
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 15743 - protein, 470 aa, Artificial Sequence
  neuraminidase__InfluenzaA__ABO32962
MNPNQKIITIGSISIAIGIISLMLQIGNIISIWASHSIQTGSKNHTGVCNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSANACHDGMGWLTIGISGPDNGAVAVLKYNGIITETIKSWKKQILRTQESECVCVNGSCFTIMTDGPSNGAASYKIFKIKKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVRQDVVAITDWSGYSGSFVQHPELTGLDCIRPCFWVELVRGLPRENTTIWTSGSSISFCGVNSDTANWSWPDGAELPFTIDK

SEQ ID NO: 15744 - protein, 470 aa, Artificial Sequence; identical to SEQ ID NO: 14386
  neuraminidase__InfluenzaA__ABO32973

SEQ ID NO: 15745 - protein, 470 aa, Artificial Sequence; identical to SEQ ID NO: 14951
  neuraminidase__InfluenzaA__ABO32984

SEQ ID NO: 15746 - protein, 470 aa, Artificial Sequence; identical to SEQ ID NO: 14951
  neuraminidase__InfluenzaA__ABO32995

SEQ ID NO: 15747 - protein, 470 aa, Artificial Sequence
  neuraminidase__InfluenzaA__ABO33009
MNPNQKIITIGSICMAIGMISLILQIGNIISIWVSHSIQTGSQNHTGICNQRIITYENSTWVNQTYVNISNTNVVAGKDTTSMTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKQILRTQESECVCVNGSCFTIMTDGPSDGPASYRIFKIEKGKITKSIELDAPNSHYEECSCYPDTGTVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 15748 - protein, 469 aa, Artificial Sequence; identical to SEQ ID NO: 15518
  neuraminidase__InfluenzaA__ABO33039

SEQ ID NO: 15749 - protein, 469 aa, Artificial Sequence
  neuraminidase__InfluenzaA__ABO33050
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSPLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15750 - protein, 469 aa, Artificial Sequence; identical to SEQ ID NO: 14730
  neuraminidase__InfluenzaA__ABO33061

SEQ ID NO: 15751 - protein, 469 aa, Artificial Sequence
  neuraminidase__InfluenzaA__ABO33072
MNPNQKIITIGSVSLTIATICFLMQIAILVTTVTLHFKQYECGSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 15752 - protein, 470 aa, Artificial Sequence; identical to SEQ ID NO: 15059
  neuraminidase__InfluenzaA__ABO37991

SEQ ID NO: 15753 - protein, 470 aa, Artificial Sequence
  neuraminidase__InfluenzaA__ABO38013
MNPNQKIITIGSISIAIGIISLILQIGNIISIWASHSIQTGSQNHTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGYEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 15754 - protein, 470 aa, Artificial Sequence
  neuraminidase__InfluenzaA__ABO38024
MNPNQKIITIGSISIAIGIISLMLQIGNIISIWASHSIQTGSQNHTGICNQRIITYENNTWVNHTYVNINNTNIVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMVWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 15755 - protein, 470 aa, Artificial Sequence
  neuraminidase__InfluenzaA__ABO38035
MNPNQKIITIGSISIAIGIISLMLQIGNIISIWASHSIQTGSQNHTGTCNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEVIWDPNGWTDTDSDFSVKQDVVAITDWSGYSGSFVQHPELTGLDCIRPCFWVELVRGMPRENTTIWTSGSSISFCGVNSDTANWSWPDGAELPFTIDK

SEQ ID NO: 15756 - protein, 470 aa, Artificial Sequence; identical to SEQ ID NO: 14396
  neuraminidase__InfluenzaA__ABO38046

SEQ ID NO: 15757 - protein, 470 aa, Artificial Sequence; identical to SEQ ID NO: 14951
  neuraminidase__InfluenzaA__ABO38068

SEQ ID NO: 15758 - protein, 469 aa, Artificial Sequence; identical to SEQ ID NO: 14327
  neuraminidase__InfluenzaA__ABO38079

SEQ ID NO: 15759 - protein, 469 aa, Artificial Sequence
  neuraminidase__InfluenzaA__ABO38090
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHERTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15760 - protein, 469 aa, Artificial Sequence
  neuraminidase__InfluenzaA__ABO38101
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTINKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 15761 - protein, 469 aa, Artificial Sequence
  neuraminidase__InfluenzaA__ABO38233
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPVVDINVKDYSIASSYVCSGLVGDTPRKNDRYSSSYCRNPNNEKGNHGVKGWAFDDGNDVWMGRTISDESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 15762 - protein, 469 aa, Artificial Sequence; identical to SEQ ID NO: 15111
  neuraminidase__InfluenzaA__ABO38244

SEQ ID NO: 15763 - protein, 469 aa, Artificial Sequence; identical to SEQ ID NO: 14327
  neuraminidase__InfluenzaA__ABO38255

SEQ ID NO: 15764 - protein, 469 aa, Artificial Sequence; identical to SEQ ID NO: 14712
  neuraminidase__InfluenzaA__ABO38277

SEQ ID NO: 15765 - protein, 469 aa, Artificial Sequence; identical to SEQ ID NO: 15739
  neuraminidase__InfluenzaA__ABO38288

SEQ ID NO: 15766 - protein, 469 aa, Artificial Sequence
  neuraminidase__InfluenzaA__ABO38299
MNPNQKIITIGSVSLTIATVCFIMQIAILATTVTLHFKQHECDSPASNQVMPCEPIIIERNITEIVYLNNTTIEKEICPEAVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHVEECSCYPRYPDVRCTCRDNWKGSNRPVIDINMEDYSIDSSYVCSGLVGDTPRNDDSSSNSNCRDPNNERGNPGVKGWAFDNGDDVWMGRTINKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 15767 - protein, 469 aa, Artificial Sequence
  neuraminidase__InfluenzaA__ABO38310
MNPNQKIITIGSVSLTIATVCFLMQIAILATTVTLHFKQHECDSPTSNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNGDSSSNSNCRDPNNERGNPGVKGWAFDNGDDVWMGRTINKESRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 15768 - protein, 470 aa, Artificial Sequence; identical to SEQ ID NO: 14930
  neuraminidase__InfluenzaA__ABO38332

SEQ ID NO: 15769 - protein, 470 aa, Artificial Sequence
  neuraminidase__InfluenzaA__ABO38343
MNPNQKIITIGSICMTIGIISLILQIGNIISIWVSHSIQTGSQNHTGICNQRIITYENSTWVNQTYVNINNTNVVAGKDTTSVTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSNGPASYRIFKIEKGKITKSIELDAPNSHYEECSCYPDTGTVMCVCRDNWHGSNRPWVSFNQNLDYQIGYICSGVFGDNPRPKDGKGSCDPVTVDGADGVKGFSYRYGNGVWIGRTKSNSSRKGFEMIWDPNGWTDTDSNFLVKQDVVAMTDWSGYSGSFVQHPELTGLDCMRPCFWVELVRGRPREGTTVWTSGSSISFCGVNSDTANWSWPDGAELPFTIDK

SEQ ID NO: 15770 - protein, 469 aa, Artificial Sequence
  neuraminidase__InfluenzaA__ABO38354
MNPNQKIITIGSICMVVGIISLILQIGNIISIWISHSIQTGSQNHTGICNQNIITYKNSTWVNQTYVNISNTNVVAGQDTTSVILTGNSSLCPIRGWAIYSKDNSIRIGSKGDVFVIREPFISCSHLECRTFFLTQGALLNDRHSNGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSNGLASYKIFKIEKGKVTKSIELNAPNSHYEECSCYPDTGKVMCVCRDNWHGSNRPWVSFDQNLDYQIGYICSGVFGDNPRPKDGTGSCGPVYVDGANGVKGFSYRYGNGVWIGRTKSNSSRHGFEMIWDPNGWTETDSKFSVRQDVVAMTDWSGYSGSFVQHPELTGLDCMRPCFWVELIRGRPKENTIWTSGSSISFCGVNSDTVDWSWPDGAELPFTIDK

SEQ ID NO: 15771 - protein, 470 aa, Artificial Sequence
  neuraminidase__InfluenzaA__ABO38365
MNPNQKIITIGSICMAIGIISLILQMGNIISIWVSHSIQTGSQNHTGICNQRIITYENSTWVNQTYVNINNTNVVAGKDTTSVTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSNGPASYRIFKIEKGKITKSIELDAPNSHYEECSCYPDTGTVMCVCRDNWHGSNRPWVSFNQNLDYQIGYICSGVFGDNPRPKDGKGSCDPVTVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTANWSWPDGAELPFTIDK

SEQ ID NO: 15772 - protein, 469 aa, Artificial Sequence
  neuraminidase__InfluenzaA__ABO38376
MNPNQKIITIGSICMVVGIISLILQIGNIISIWISHSIQTGSQNHTGTCNQSIITYKNSTWVNQTYVNISNTNVVAGKDTTSVILAGNSSLCPIRGWAIYSKDNGVRIGSKGDVFVIREPFISCSHLECRTFFLTQGALLNDKHSNGTVKDRSPYRALMSCPVGEAPSPYNSRFESVAWSASACHDGMGWLTIGISGPDDGAVAVLKYNGIITETIKSWRKEILRTQESECACVNGSCFTIMTDGPSGGPASYKIFKIEKGKVTKSIELDAPNSHYEECSCYPDTGKVMCVCRDNWHGSNRPWVSFDQNLDYQMGYICSGVFGDNPRPKDGKGNCGPVYVDGANGVKGFSYRYGNGVWIGRTKSNSSRQGFEMIWDPNGWTETDSNFFVKQDVVAVTDWSGYSGSFVQHPELTGLDCMRPCFWVELIRGRPKEKTIWTSGSSISFCGVNSDTVDWSWPDGAELPFTIDK

SEQ ID NO: 15773 - protein, 469 aa, Artificial Sequence
  neuraminidase__InfluenzaA__ABO38387
MNPNQKIITIGSICMVVGIISLILQIGNIISIWISHSIQTGSQNHTGICNQSIITYKNSTWVNQTYVNISNTNVVAGQDTTSVILTGNSSLCPIRGWAIYSKDNGIRIGSKGDVFVIREPFISCSHLECRTFFLTQGALLNDKHSNGTVKDRSPYRALMSCPVGEAPSPYNSRFESVAWSASACHDGMGWLTIGISGPDNEAVAVLKYNGIITETIKSWRKKILRTQESECACVNGSCFTIMTDGPSDGLASYKIFKIEKGKVTKSIELNAPNSHYEECSCYPDTGKVMCVCRDNWHGSNRPWVSFDQNLDYQIGYICSGVFGDNPRPKDGTGSCGPVYVDGANGVKGFSYRYGNGVWIGRTKSTSSRHGFEMIWDPNGWTETDSKFSVRQDVVAMTDWSGYSGSFVQHPELTGLDCMRPCFWVELIRGQPKEKTIWTSGSSISFCGVNSDTVDWSWPDGAELPFTIDK

SEQ ID NO: 15774 - protein, 470 aa, Artificial Sequence
  neuraminidase__InfluenzaA__ABO38398
MNPNQKIITIGSICMAIGIISLILQIGNIVSIWISHSIQTGSQNYTGICNQRIITYENSTWVNQTYVNINNTNVVAGQDTTSVALAGNSSLCPISGWAIYSKDNSIRIGSKGDVFVIREPFISCSHLECRNFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPNNGPASYKIFKIEKGKITKSIELDAPNSHYEECSCYPDAGTVMCVCRDNWHGSNRPWVSFNQNLDYQIGYICSGVFGDNPRPKDGKGSCDPVTVDGADGVKGFSYRYGNGVWIGRTKSNSSRRGFEMIWDPNGWTDTDSKFLVKQDVVAMTDWSGYSGSFVQHPELTGLDCMRPCFWVELIRGRPRENTTIWTSGSSISFCGVNGDTANWSWPDGAELPFTIDK

SEQ ID NO: 15775 - protein, 469 aa, Artificial Sequence; identical to SEQ ID NO: 14253
  neuraminidase__InfluenzaA__ABO38420

SEQ ID NO: 15776 - protein, 469 aa, Artificial Sequence
  neuraminidase__InfluenzaA__ABO38715
MNPNQKIITIGSVSLTIATVCFLMQIAILVTTVTLHFKQHECDSPASNQVMPCEPIIIERNITEIVYLNNTTIEKETCPKVVEYRSWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPIVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 15777 - protein, 469 aa, Artificial Sequence; identical to SEQ ID NO: 15776
  neuraminidase__InfluenzaA__ABO38726

SEQ ID NO: 15778 - protein, 470 aa, Artificial Sequence
  neuraminidase__InfluenzaA__ABO44049
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVICVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 15779 - protein, 469 aa, Artificial Sequence
  neuraminidase__InfluenzaA__ABO44060
MNPNQKIITIGSVSLTIATVCFLMQIAILVTTVTLHFKQHECDSPASNQVMPCEPIIIERNITEIVYLNNTTIEKEICPKVVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTKILFIEEGKIVHISPLSGSAQHVEECSCYPRYPDVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINLMPI

SEQ ID NO: 15780 - protein, 469 aa, Artificial Sequence
  neuraminidase__InfluenzaA__ABO44071
MNPNQKIITIGFVFLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCKNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 15781 - protein, 469 aa, Artificial Sequence; identical to SEQ ID NO: 14346
  neuraminidase__InfluenzaA__ABO44082

SEQ ID NO: 15782 - protein, 469 aa, Artificial Sequence
  neuraminidase__InfluenzaA__ABO44093
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVLDISMEDYSIDSSYVCSGLVGDTPRNDDSSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRSQETRVWWTSNSIVVFCGTSGTYGTGSWPDGANINFMPI

SEQ ID NO: 15783 - protein, 469 aa, Artificial Sequence
  neuraminidase__InfluenzaA__ABO44104
MNPNQKIITIGSASLTIATVCFLMQIAILVTTVTLHFKQHECDSPASNQVMPCEPIIIERNITEIVYLNNTTIEKEICPKVVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPVVDINMEDYSIDSSYVCSGLVGDTPRNDDRSSNSNCRNPNNEKGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINLMPI

SEQ ID NO: 15784 - protein, 470 aa, Artificial Sequence
  neuraminidase__InfluenzaA__ABO44126
MNPNQKIITIGSICMAIGIISLILQIGNIVSIWISHSIQTGSQNYTGICNQRIITYENSTWVNQTYVNINNTNVVAGQDTTSVALAGNSSLCPISGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPNNGPASYKIFKIEKGKITKSIELNAPNSHYEECSCYPDAGTVMCVCRDNWHGSNRPWVSFNQNLDYQIGYICSGVFGDNPRPKDGKGSCGPVTVDGADGVKGFSYRYGNGVWIGRTKSNSSRRGFEMIWDPNGWTDTDSKFLVKQDVVAITDWSGYSGSFVQHPELTGLDCMRPCFWVELIRGRPRENTTIWTSGSSISFCGVNGDTANWSWPDGAELPFTIDK

SEQ ID NO: 15785 - protein, 470 aa, Artificial Sequence
  neuraminidase__InfluenzaA__ABO52228
MNPNQKIITIGSISIAIGIISLILQIGNIISIWASHSIQTGSQNHTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSKFESVAWSASACHDGLGWLTIGISGPDNGAVAVLKYNGIITETIKSWKKRILRTQESECVCMNGSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 15786 - protein, 469 aa, Artificial Sequence
  neuraminidase__InfluenzaA__ABO52239
MNPNQKIITIGSVSLTIATVCFIMQIAILATTVTLHFKQHECDSPASNQVMPCEPIIIERNITEIVYLNNTTIEKEICPEAVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDKNATASFIYDGRLVDSIGSWSQNILRTQESECVCINGTCTVVMTDGSASGRADTRILFIKEGKIVHISPLSGSAQHVEECSCYPRYPDVRCICRDNWKGSNRPVIDINMEDYSIDSSYVCSGLVGDTPRNDDSSSNSNCRDPNNERGNPGVKGWAFDNGDDVWMGRTINKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 15787 - protein, 469 aa, Artificial Sequence; identical to SEQ ID NO: 15783
  neuraminidase__InfluenzaA__ABO52250

SEQ ID NO: 15788 - protein, 470 aa, Artificial Sequence
  neuraminidase__InfluenzaA__ABO52261
MNPNQKIITIGSICMAIGIISLILQIGNIISIWVSHSIQTGSQNHTGICNQRIITYENSTWVNQTYVNINNTNVVAGKDTTSVTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSNGPASYRIFKIEKGKITKSIELDAPNSHYEECSCYPDTGTVMCVCRDNWHGSNRPWVSFNQNLDYQIGYICSGVFGDNPRPKDGKGSCDPVTVDGADGVKGFSYRYGNGVWIGRTKSNSSRKGFEMIWDPDGWTDTDSNFLVKQDVVAMTDWSGYSGSFVQHPELTGLDCIRPCFWVELIRGRPREKTTIWTSGSSISFCGVNSDTVNWSWPDGAELPFTIDK

SEQ ID NO: 15789 - protein, 470 aa, Artificial Sequence
  neuraminidase__InfluenzaA__ABO52283
MNPNQKIITIGSICMTIGTISLILQIGNIISIWISHSIQTGSQNHTGICNQRIITYENNTWVNQTYVNISNTNVVAGKDTTSMILAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITEIIKSWRKQILRTQESECVCVNGSCFTIMTDGPSDGPASYRIFKIEKGKITKSIELDAPNSHYEECSCYPDTGKVMCVCRDNWHGSNRPWVSFNQNLDYQIGYICSGVFGDNPRPKDGKGSCDPVNVDGADGVKGFSYRYGDGVWIGRTKSNSSRKGFEMIWDPNGWTDTDDNFLVKQDVVAMTDWSGYSGSFVQHPELTGLDCMRPCFWVELIRGRPREKTTIWTSGSSISFCGVNSDTVNWSWPDGAELPFTIDM

SEQ ID NO: 15790 - protein, 469 aa, Artificial Sequence; identical to SEQ ID NO: 15518
  neuraminidase__InfluenzaA__ABO52294

SEQ ID NO: 15791 - protein, 469 aa, Artificial Sequence
  neuraminidase__InfluenzaA__ABO52316
MNPNQKIITIGSVSLTIATICFLMQIAILVTTVTLHFKQYECDSPANNQIMPCEPTIIERNITEIVYLTNITIEKEICPKLVEYRNWSKPQCKITGFAPFSKDNSIRLSAGGDIWVTREPYVSCDPSRCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRKNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGAGSWPDGADINLMPI

SEQ ID NO: 15792 - protein, 469 aa, Artificial Sequence; identical to SEQ ID NO: 14114
  neuraminidase__InfluenzaA__ABO52327

SEQ ID NO: 15793 - protein, 469 aa, Artificial Sequence
  neuraminidase__InfluenzaA__ABO52338
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSKNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSSSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 15794 - protein, 469 aa, Artificial Sequence
  neuraminidase__InfluenzaA__ABO52349
MNPNQKIITIGSVSLTIATICFLMQIAILVTTVTLHFKQYECDSPANNQVMPCEPIIIERNVTEIVYLTNTTIEKEICPKLVEYRNWSKPQCKITGFAPFSKDNSIRLSAGGDIWVTREPYVSCDPGKCYQFALGQGTTLDNKHSNDTIHDRTPYRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIIHISPLSGSAQHVEECSCYPRYPGVRCICRDNWKGSNRPVVDINMRDYSIVSSYVCSGLVGDTPRKNDRSSSSYCRNPNNEKGNHGVKGWAFDDGNDVWMGRTISEESRSGYETFKVIGGWSTPNSKLQINRQVIVDSNNRSGYSGIFSVEGKSCINRCFYVELIRGREQETRVWWTSNSIVVFCGTSGTYGTGSWPDGADINLMPI

SEQ ID NO: 15795 - protein, 469 aa, Artificial Sequence
  neuraminidase__InfluenzaA__ABO52360
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGNDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 15796 - protein, 469 aa, Artificial Sequence
  neuraminidase__InfluenzaA__ABO52371
MNPNQKIITIGSVSLTIATVCFLMQIAILVTTVTLHFRQYECDSPANNQVMPCEPIIIERNITEIVYLNNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGKLVDSIGSWSQNILRTQESECVCINGTCTVVMTDGSASGRADTRILFIEEGKIVHISPLSGSAQHVEECSCYPRYPGVRCICRDNWKGSNRPVVDINVEDYSIDSSYVCSGLVGDTPRNNDRSGNSNCRNPNNERGNHGVKGWAFDDGNDVWMGRTINKDLRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 15797 - protein, 470 aa, Artificial Sequence
  neuraminidase__InfluenzaA__ABO52800
MNPNQKIITIGSICMTIGIISLILQIGNIISIWVSHSIQTGSQNHTGICNQRIITYENSTWVNQTYVNINNTNVVAGKDTTSVTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSNGPASYRIFKIEKGKITKSIELDAPNSHYEECSCYPDTGTVMCVCRDNWHGSNRPWVSFNQNLDYQIGYICSGVFGDNPRPKDGKGSCDPVTVDGADGVKGFSYRYGNGVWIGRTKSNSSRKGFEMIWDPNGWTDTDSNFLVKQDVVAMTDWSGYSGSFVQHPELTGLDCMRPCFWVELIRGRPRERTTIWTSGSSISFCGVNSDTANWSWPDGAELPFTIDK

SEQ ID NO: 15798 - protein, 470 aa, Artificial Sequence; identical to SEQ ID NO: 14828
  neuraminidase__InfluenzaA__ABP49220

SEQ ID NO: 15799 - protein, 470 aa, Artificial Sequence
  neuraminidase__InfluenzaA__ABP49319
MNPNQKIITIGSICMAIGIISLILQIGNIISIWVSHSIQTGSQNHTGICNQRIITYENNTWVNQTYVNISNTNVVAGKDTTSMILAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKQILRTQESECVCVNGSCFTIMTDGPSDGPASYRIFKIEKGKITKSIELDAPNSHYEECSCYPDTGKVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDGNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 15800 - protein, 469 aa, Artificial Sequence
  neuraminidase__InfluenzaA__ABP49330
MNPNQKIITIGSICMVVGIISLILQIGNIISIWISHSIQTGSQNHTGICNQSIITYKNSTWVNQTYVNISNTNVVAGKGTTPVILAGNSSLCPIRGWAIYSKDNGIRIGSKGDVFVIREPFISCSHLECRTFFLTQGALLNDKHSNGTVKDRSPYRALMSCPVGEAPSPYNSRFESVAWSACACHDGMGWLTIGISGPDDEAVAVLKYNGIITETIKSWRKKILRTQESECVCVNGSCFTIMTDGPSDGPASYKIFKIEKGKVTKSIELDAPNSHYEECSCYPDTGKVMCVCRDNWHGSNRPWVSFDQNLDYQIGYICSGVFGDNPRPKDGKGSCGPVYVDGANGVKGFSYRYGNGVWIGRIKSNSSRQGFEMIWDPNGWTETDSSFFVKQDVVAMTDWSGYSGSFVQHPELTGLDCMRPCFWVELIRGRPKEKTIWTSGSSISFCGVNSDTVDWSWPDGAELPFTIDK

SEQ ID NO: 15801 - protein, 470 aa, Artificial Sequence
  neuraminidase__InfluenzaA__ABP49352
MNPNQKIITIGSICMTIGIISLILQIGNIISIWVSHSIQTGSQNHTGICNQRIITYENSTWVNQTYVNINNTNVVAGKDTTSVALAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSDGPASYRIFKIEKGKITKSIELDAPNSHYEECSCYPDTGTVMCVCRDNWHGSNRPWVSFNQNLDYQIGYICSGVFGDNPRPKDGKGSCGPVTVDGADGVKGFSYKYGNGVWIGRTKSNSSRKGFEMIWDPNGWTDTDSNFLVKQDVVAMTDWSGYSGSFVQHPELTGLDCMRPCFWVELIRGRPRERTTIWTSGSSISFCGVDSDTANWSWPDGAELPFTIDK

SEQ ID NO: 15802 - protein, 470 aa, Artificial Sequence; identical to SEQ ID NO: 15698
  neuraminidase__InfluenzaA__ABP49363

SEQ ID NO: 15803 - protein, 469 aa, Artificial Sequence; identical to SEQ ID NO: 14730
  neuraminidase__InfluenzaA__ABP49374

SEQ ID NO: 15804 - protein, 470 aa, Artificial Sequence
  neuraminidase__InfluenzaA__ABP49385
MNPNQKIITIGSISVAIGIINLTLQIGNIISIWASHSIQTGSQNYTGICNQRIITYENRTWVNQTYVNINNTNVVAGKDKTSMTLAGNSSLCPIRGWAIYTKDNSIRIGSKGDVFVIREPFISCSHLECRTFFLTQGALLNDKHSNGTIKDRSPFRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 15805 - protein, 470 aa, Artificial Sequence; identical to SEQ ID NO: 14386
  neuraminidase__InfluenzaA__ABP49396

SEQ ID NO: 15806 - protein, 469 aa, Artificial Sequence
  neuraminidase__InfluenzaA__ABP49407
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMSELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKICINRCFYVELIRGRKEETEVLWTSNSIVVFCGTSGTYGTGSWPDGADINLMPI

SEQ ID NO: 15807 - protein, 469 aa, Artificial Sequence; identical to SEQ ID NO: 14730
  neuraminidase__InfluenzaA__ABP49418

SEQ ID NO: 15808 - protein, 469 aa, Artificial Sequence; identical to SEQ ID NO: 14730
  neuraminidase__InfluenzaA__ABP49429

SEQ ID NO: 15809 - protein, 469 aa, Artificial Sequence
  neuraminidase__InfluenzaA__ABP49440
MNPNQKIITIGSVSLTIATVCFLIQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDSRSGYETFKVIGGWSTPNSKSQANRQVIVDKNNWSGYSGIFSVEGKSCINRCFYVELIRGRPQETRVWWTSNSIVVFCGTSGTYGTGSWPDGANINFMPI

SEQ ID NO: 15810 - protein, 470 aa, Artificial Sequence; identical to SEQ ID NO: 14951
  neuraminidase__InfluenzaA__ABP49451

SEQ ID NO: 15811 - protein, 469 aa, Artificial Sequence
  neuraminidase__InfluenzaA__ABP49462
MNPNQKIITIGSVSLTIATVCFIMQIAILATTVTLHFKQHECDSPASNQVMPCEPIIIERNITEIVYLNNTTIEKEICPEAVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTINKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 15812 - protein, 469 aa, Artificial Sequence; identical to SEQ ID NO: 15760
  neuraminidase__InfluenzaA__ABP49473

SEQ ID NO: 15813 - protein, 469 aa, Artificial Sequence
  neuraminidase__InfluenzaA__ABP49495
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHTSPLSGSAQHVEECSCYPRYPGVRCICRDNWRGSNRPVVDINVKDYSIDSSYVCSGLVGDTPRNNDRSSSSYCRNPNNEKGTHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 15814 - protein, 469 aa, Artificial Sequence; identical to SEQ ID NO: 14103
  neuraminidase__InfluenzaA__ABP49506

SEQ ID NO: 15815 - protein, 469 aa, Artificial Sequence; identical to SEQ ID NO: 14095
  neuraminidase__InfluenzaA__ABP49517

SEQ ID NO: 15816 - protein, 470 aa, Artificial Sequence
  neuraminidase__InfluenzaA__ABQ01314
MNPNQKIITIGSICMAIGTISLILQIGNIISIWVSHSIQTGSQNHTGICNQRIITYENNTWVNQTYVNISNTNVVAGKDTTSMILAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITEIIKSWRKQILRTQESECVCVNGSCFTIMTDGPSDGPASYRIFKIEKGKITKSIELDAPNSHYEECSCYPDTGKVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDGNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 15817 - protein, 470 aa, Artificial Sequence
  neuraminidase__InfluenzaA__ABQ01325
MNPNQKIITIGSICMAIGIISLILQIGNIISIWVSHSIQTGSQNHTGICNQRIITYENSTWVNQTYVNISNTNVVAGKDTTSMTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKQILRTQESECVCVNGSCFTIMTDGPSDGQASYRIFKIEKGKITKSIELDAPNSHYEECSCYPDTGTVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 15818 - protein, 469 aa, Artificial Sequence; identical to SEQ ID NO: 14730
  neuraminidase__InfluenzaA__ABQ01336

SEQ ID NO: 15819 - protein, 469 aa, Artificial Sequence; identical to SEQ ID NO: 14730
  neuraminidase__InfluenzaA__ABQ01347

SEQ ID NO: 15820 - protein, 469 aa, Artificial Sequence
  neuraminidase__InfluenzaA__ABQ01358
MNPNQKIITIGSVSLTIATVCFLMQIAILATTVTLHFKQHECNSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLEDSIGSWSQNILRTQESECVCINGTCTVVMTDGNASGRADTRILFIKEGKIVHISPLSGSAQHIEECSCYPRYPDVRCICRDNWKGSNRPVLDISMEDYSIDSSYVCSGLVGDTPRNDDSSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRSQETRVWWTSNSIVVFCGTSGTYGTGSWPDGANINFMPI

SEQ ID NO: 15821 - protein, 469 aa, Artificial Sequence
  neuraminidase__InfluenzaA__ABQ01369
MNPNQKIITIGSVSLTIATICFVMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHTSPLSGSAQHVEECSCYPRYPGVRCICRDNWKGSNRPVVDINVKDYSIDSSYVCSGLVGDTPRKNDRSSSSYCRNPNNEKGTHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 15822 - protein, 469 aa, Artificial Sequence
  neuraminidase__InfluenzaA__ABQ44386
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVESKSCINRCFYVELIRGRKQENEVLWTSNSIVVFCGTSGTYGTGSWPDGADINLMPI

SEQ ID NO: 15823 - protein, 469 aa, Artificial Sequence; identical to SEQ ID NO: 14714
  neuraminidase__InfluenzaA__ABQ44408

SEQ ID NO: 15824 - protein, 470 aa, Artificial Sequence
  neuraminidase__InfluenzaA__ABQ44419
MNPNQKIITIGSICMAIGIISLILQIGNIVSIWISHSIQNGSQNYTGICNQRIITYENSTWVNQTYVNINNTNVVAGQDTTSVALAGNSSLCPISGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPNNGPASYKIFKIEKGKITKSIELDAPNSHYEECSCYPDAGTVMCVCRDNWHGSNRPWVSFNQNLDYQIGYICSGVFGDNPRPKDGKGSCGPVTVDGADGVKGFSYRYGNGVWIGRTKSNSSRRGFEMIWDPNGWTDTDSKFLVKQDVVAMTDWSGYSGSFVQHPELTGLDCMRPCFWVELIRGRPRENTTIWTSGSSISFCGVNGDTANWSWPDGAELPFTIDK

SEQ ID NO: 15825 - protein, 469 aa, Artificial Sequence; identical to SEQ ID NO: 14346
  neuraminidase__InfluenzaA__ABQ44430

SEQ ID NO: 15826 - protein, 469 aa, Artificial Sequence; identical to SEQ ID NO: 15776
  neuraminidase__InfluenzaA__ABQ44441

SEQ ID NO: 15827 - protein, 469 aa, Artificial Sequence; identical to SEQ ID NO: 15760
  neuraminidase__InfluenzaA__ABQ44463

SEQ ID NO: 15828 - protein, 470 aa, Artificial Sequence
  neuraminidase__InfluenzaA__ABQ44474
MNPNQKIITIGSICMTIGTISLILQIGNIISIWVSHSIQTGSQNHTGICNQRIITYENNTWVNQTYVNISNTNVVAGKDTTSMILAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITEIIKSWRKQILRTQESECVCVNGSCFTIMTDGPSDGPASYRIFKIEKGKITKSIELDAPNSHYEECSCYPDTGKVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDGNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 15829 - protein, 469 aa, Artificial Sequence; identical to SEQ ID NO: 14095
  neuraminidase__InfluenzaA__ABR15800

SEQ ID NO: 15830 - protein, 470 aa, Artificial Sequence; identical to SEQ ID NO: 15816
  neuraminidase__InfluenzaA__ABR15811

SEQ ID NO: 15831 - protein, 470 aa, Artificial Sequence; identical to SEQ ID NO: 14828
  neuraminidase__InfluenzaA__ABR15910

SEQ ID NO: 15832 - protein, 469 aa, Artificial Sequence; identical to SEQ ID NO: 14154
  neuraminidase__InfluenzaA__ABR15932

SEQ ID NO: 15833 - protein, 469 aa, Artificial Sequence
  neuraminidase__InfluenzaA__ABR15943
MNPNQKIITIGSVSLTIATICFLMQIAILVTTVTLHFRQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15834 - protein, 469 aa, Artificial Sequence
  neuraminidase__InfluenzaA__ABR15954
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNNSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15835 - protein, 469 aa, Artificial Sequence; identical to SEQ ID NO: 14154
  neuraminidase__InfluenzaA__ABR15965

SEQ ID NO: 15836 - protein, 469 aa, Artificial Sequence
  neuraminidase__InfluenzaA__ABR22243
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSPLSGSAQHVEECSCYPRYPGVRCVCRDNWKGSNRPIVDINVKDYSIVSSYVCSGLVGDTPRKTDSSSSSHCLDPNNEEGGHGVKGWAFDDGNDVWMGRTISEKSRSGYETFKVIEGWSKPNSKLQINRQVIVDRGNRSGYSGIFSVEGKSCINRCFYVELIRGRKQETEVLWTSNSIVVFCGTSGTYGTGSWPDGADLNLMPI

SEQ ID NO: 15837 - protein, 469 aa, Artificial Sequence; identical to SEQ ID NO: 14730
  neuraminidase__InfluenzaA__ABR28518

SEQ ID NO: 15838 - protein, 469 aa, Artificial Sequence; identical to SEQ ID NO: 14576
  neuraminidase__InfluenzaA__ABR28595

SEQ ID NO: 15839 - protein, 470 aa, Artificial Sequence
  neuraminidase__InfluenzaA__ABR28771
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSRELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 15840 - protein, 470 aa, Artificial Sequence
  neuraminidase__InfluenzaA__ABR28782
MNPNQKIITIGSISIAIGILSLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 15841 - protein, 469 aa, Artificial Sequence; identical to SEQ ID NO: 14844
  neuraminidase__InfluenzaA__ABR28793

SEQ ID NO: 15842 - protein, 470 aa, Artificial Sequence; identical to SEQ ID NO: 14828
  neuraminidase__InfluenzaA__ABR28804

SEQ ID NO: 15843 - protein, 469 aa, Artificial Sequence; identical to SEQ ID NO: 14730
  neuraminidase__InfluenzaA__ABR28815

SEQ ID NO: 15844 - protein, 469 aa, Artificial Sequence; identical to SEQ ID NO: 14154
  neuraminidase__InfluenzaA__ABR28826

SEQ ID NO: 15845 - protein, 470 aa, Artificial Sequence; identical to SEQ ID NO: 14396
  neuraminidase__InfluenzaA__ABR28837

SEQ ID NO: 15846 - protein, 470 aa, Artificial Sequence
  neuraminidase__InfluenzaA__ABR28848
MNPNQKIITIGSISIAIGIISLMLQIGNIISIWASHSIQTGSQNHTGVCNQRIITYENSTWVNHTYVNINNTNVIVGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKITKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMVWDPNGWTDTDSDFSVKQDVVAITDWSGYSGSFVQHPELTGLNCIRPCFWVELVRGLPKENTTIWTSGSSISFCGVNSDTANWSWPDGAELPFTIDK

SEQ ID NO: 15847 - protein, 469 aa, Artificial Sequence
  neuraminidase__InfluenzaA__ABR28859
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHGRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15848 - protein, 469 aa, Artificial Sequence
  neuraminidase__InfluenzaA__ABR28870
MNPNQKIITIGSVSLTIATICFLMQIAILVTTVTLHFKQYECNSPPNNQVMLCEPTIIERNITETVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15849 - protein, 469 aa, Artificial Sequence
  neuraminidase__InfluenzaA__ABR28881
MNPNQKIITIGSVSLTIATVCFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15850 - protein, 469 aa, Artificial Sequence; identical to SEQ ID NO: 14714
  neuraminidase__InfluenzaA__ABR28892

SEQ ID NO: 15851 - protein, 470 aa, Artificial Sequence; identical to SEQ ID NO: 14386
  neuraminidase__InfluenzaA__ABR28903

SEQ ID NO: 15852 - protein, 469 aa, Artificial Sequence
  neuraminidase__InfluenzaA__ABR28925
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEVLRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15853 - protein, 469 aa, Artificial Sequence
  neuraminidase__InfluenzaA__ABR88082
MDPNQKIITIGSVSLTISTICFFMQTAILITTVTLHFKQYEFNSPPNNQVMLCEPTIIERNITEIVYLTNTIIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKNYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15854 - protein, 470 aa, Artificial Sequence
  neuraminidase__InfluenzaA__ABS00324
MNPNQKIITIGSICMAIGIISLILQIGNIVSIWISHSIQTGSQNYTGICNQRIITYENSTWVNQTYVNINNTNVVAGQDTTSVALAGNSSLCPISGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPNNGPASYKIFKIEKGKITKSIELDAPNSHYEECSCYPDAGTVMCVCRDNWRGSNRPWVSFNQSLDYQIGYICSGVFGDNPRPKDGKGSCDPVTVDGADGVKGFSYRYGNGVWIGRTKSNSSRRGFEMIWDPNGWTDTDSKFLVKQDVVAMTDWSGYSGSFVQHPELTGLDCMRPCFWVELIRGRPRENTTIWTSGSSISFCGVNGDTANWSWPDGSELPFTIDK

SEQ ID NO: 15855 - protein, 469 aa, Artificial Sequence; identical to SEQ ID NO: 14114
  neuraminidase__InfluenzaA__ABS49902

SEQ ID NO: 15856 - protein, 469 aa, Artificial Sequence
  neuraminidase__InfluenzaA__ABS49913
MNPNQKIITIGSVSLTIATVCFLMQIAILVTTVTLHFRQYECDSPTNNQVMPCEPIIIERNITEIVYLNNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINVEDYSIDSSYVCSGLVGDTPRNNDRSSNSNCRNPNNERGNHGVKGWAFDDGNDVWMGRTISKDLRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 15857 - protein, 469 aa, Artificial Sequence; identical to SEQ ID NO: 14844
  neuraminidase__InfluenzaA__ABS49968

SEQ ID NO: 15858 - protein, 470 aa, Artificial Sequence; identical to SEQ ID NO: 15840
  neuraminidase__InfluenzaA__ABS49979

SEQ ID NO: 15859 - protein, 470 aa, Artificial Sequence
  neuraminidase__InfluenzaA__ABS49990
MNPNQKIITIGSISIAIGIISLMLQIGNIISIWASHSIQTGSQNHTGICNQRIITYENSTWVNHTYVNINNTNVVAGKDKTSVILAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 15860 - protein, 469 aa, Artificial Sequence; identical to SEQ ID NO: 14730
  neuraminidase__InfluenzaA__ABS50001

SEQ ID NO: 15861 - protein, 469 aa, Artificial Sequence; identical to SEQ ID NO: 14730
  neuraminidase__InfluenzaA__ABS50012

SEQ ID NO: 15862 - protein, 469 aa, Artificial Sequence
  neuraminidase__InfluenzaA__ABS50023
MNPNQKIITIGSVSLTIATICFLMQIAVLVTTVTLHFKQYECNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDIVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15863 - protein, 469 aa, Artificial Sequence; identical to SEQ ID NO: 14730
  neuraminidase__InfluenzaA__ABS50034

SEQ ID NO: 15864 - protein, 469 aa, Artificial Sequence
  neuraminidase__InfluenzaA__ABS50045
MNPNQKIITIGSVSLTIATICFLMQTAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTIHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15865 - protein, 469 aa, Artificial Sequence; identical to SEQ ID NO: 14154
  neuraminidase__InfluenzaA__ABS50056

SEQ ID NO: 15866 - protein, 469 aa, Artificial Sequence; identical to SEQ ID NO: 14180
  neuraminidase__InfluenzaA__ABS50067

SEQ ID NO: 15867 - protein, 469 aa, Artificial Sequence; identical to SEQ ID NO: 14714
  neuraminidase__InfluenzaA__ABS50078

SEQ ID NO: 15868 - protein, 470 aa, Artificial Sequence
  neuraminidase__InfluenzaA__ABS71644
MKPNQKIITIGSISIAIGIISLILQIGNIISIWASHSIQTESQNHTGICNQRIITYENSTWVNNTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGAASYKIFKIEKGKVTKTMELNAPNFHYEECSCYPDTGTVMCVCRDNWHGSNRPWVSFNQNLDYQIGYICSGVFGDNPRPKDGEGSCNPVTVDGADGVKGFSYKYGNGVWMGRTKSNRLRKGFEMIWDPNGWTNTDSDFSVKQDVVAITDWSGYSGSFVQHPELTGLDCIRPCFWVELVRGLPRENTTIWTSGSSISFCGVNSGTANWSWPDGAELPFTIDK

SEQ ID NO: 15869 - protein, 470 aa, Artificial Sequence
  neuraminidase__InfluenzaA__ABS71646
MNPNQKIITIGSISIAIGIISLILQIGNIISIWASHSIQTESQNHTGICNQRIITYENSTWVNNTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGAASYKIFKIEKGKVTKTMELNAPNFHYEECSCYPDTGTVMCVCRDNWHGSNRPWVSFNQNLDYQIGYICSGVFGDNPRPKDGEGSCNPVTVDGADGVKGFSYKYGNGVWMGRTKSNRLRKGFEMIWDPNGWTNTDSDFSVKQDVVAITDWSGYSGSFVQHPELTGLDCIRPCFWVELVRGLPRENTTIWTSGSSISFCGVNSGTANWSWPDGAELPFTIDK

SEQ ID NO: 15870 - protein, 470 aa, Artificial Sequence
  neuraminidase__InfluenzaA__ABS71647
MNPNQKIITIGSISIAIGIISLILQIGNIISIWASHSIQTESQNHTGICNQRIITYENSTWVNNTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWRKRILRTQESECVCMNGSCFTIMTDGPSNGAASYKIFKIEKGKVTKTMELNAPNFHYEECSCYPDTGTVMCVCRDNWHGSNRPWVSFNQNLDYQIGYICSGVFGDNPRPKDGEGSCNPVTVDGADGVKGFSYKYGNGVWMGRTKSNRLRKGFEMIWDPNGWTNTDSDFSVKQDVVAITDWSGYSGSFVQHPELTGLDCIRPCFWVELVRGLPRENTTIWTSGSSISFCGVNSGAANWSWPDGAELPFTIDK

SEQ ID NO: 15871 - protein, 470 aa, Artificial Sequence
  neuraminidase__InfluenzaA__ABS71648
MNPNQKIITIGSISIAIGIISLILQIGNIISIWASHSIQTGNQNHTGICNQRIITYENSTWVNNTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGAASYKIFKIEKGKVTKTIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPKENTTIWTSGSSISFCGVNSGTANWSWPDGAELPFTIDK

SEQ ID NO: 15872 - protein, 470 aa, Artificial Sequence
  neuraminidase__InfluenzaA__ABS71649
MNPNQKIITIGSISIAIGIISLMLQIGNIISIWASHSIQTGSQNHTGICNQRIITYENSTWVNHTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNRAASYKIFKIEKGKVTKSIELNAPNFHYEECSCYPDTGIVMCVCRDNWHGSNRPWVSFNQNLDYQIGYICSGVFGDNPRPKDGEGSCNPVTVDGADGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 15873 - protein, 470 aa, Artificial Sequence
  neuraminidase__InfluenzaA__ABS71651
MNPNQKIITIGSISIAIGIISLMLQIGNIISIWASHSIQTGSQNHTGICNQRIITYENNTWVNHTYVNINNTNVVAGKDKTSVTLAGNSSLCSVSGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKRILRTQESECVCMNGSCFTIMTDGPSNGAASYKIFKIEKGKVTKSIELNAPSFHYEECSCYPDTGTVMCVCRDNWHGSNRPWVSFNQNLDYQIGYICSGVFGDNPRPKDGEGSCNPVTVDGADGVKGFSYKYGNGVWLGRTKSNRLRKGFEMIWDPNGWTNTDSDFSVKQDVVAITDWSGYSGSFVQHPELTGLDCIRPCFWVELVRGLPRENTTIWTSGSSISFCGVNSNTANWSWPDGAELPFTIDK

SEQ ID NO: 15874 - protein, 470 aa, Artificial Sequence
  neuraminidase__InfluenzaA__ABS71652
MNPNQKIITIGSISIAIGIISLMLQIGNIISIWASHSIQTGSQNHTGICNQRIITYENNTWVNHTYVNINNTNVVAGKDKTSVTLAGNSSLCSVSGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCMNGSCFTIMTDGPSNGAASYKIFKIEKGKVTKSIELNAPSFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSNTANWSWPDGAELPFTIDK

SEQ ID NO: 15875 - protein, 470 aa, Artificial Sequence
  neuraminidase__InfluenzaA__ABS71653
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMICPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSRELNAPNFHYEECSCYPDIGTVMCVCRDNWHGSNRPWVSFNQNLDYQIGYICSGVFGDNPRPKDGKGSCNPVTADGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 15876 - protein, 469 aa, Artificial Sequence
  neuraminidase__InfluenzaA__ABS71655
MNPIKKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15877 - protein, 469 aa, Artificial Sequence
  neuraminidase__InfluenzaA__ABS71657
MNPNQKIITIGSVSLTISTICFFMQIAILITTVTLHFKQYEFSSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDAWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15878 - protein, 469 aa, Artificial Sequence
  neuraminidase__InfluenzaA__ABS71659
MNPIKKIITIGSVSLTISTICFFMQIAILITTVTLHFKQYEFSSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTIGEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINHMPI

SEQ ID NO: 15879 - protein, 469 aa, Artificial Sequence
  neuraminidase__InfluenzaA__ABS71660
MNPIKKIITIGSVSLTISTICFFMQIAILITTVTLHFKQYEFSSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15880 - protein, 469 aa, Artificial Sequence
  neuraminidase__InfluenzaA__ABS71661
MYPIKKIITIGSVSLTISTICFFMQIAILITTVTLHFKQYEFSSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15881 - protein, 469 aa, Artificial Sequence
  neuraminidase__InfluenzaA__ABS71662
MNPIKKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15882 - protein, 469 aa, Artificial Sequence
  neuraminidase__InfluenzaA__ABS71663
MYPIKKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDQNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPNSKLQMNRQVIVDRGNRSGYSGIFSVEGKSCINRCFYVELIRGRKEETEVLWTSNSIVVFCGTSGTYGTGSWPDGADINLMPI

SEQ ID NO: 15883 - protein, 469 aa, Artificial Sequence
  neuraminidase__InfluenzaA__ABU40956
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDNCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIIDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 15884 - protein, 469 aa, Artificial Sequence
  neuraminidase__InfluenzaA__ABU50651
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 15885 - protein, 469 aa, Artificial Sequence
  neuraminidase__InfluenzaA__ABU80180
MNPNQKIITIGSVSLTIATICFLMQIAILVTTVTLHFKQYECNSFPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15886 - protein, 470 aa, Artificial Sequence; identical to SEQ ID NO: 14828
  neuraminidase__InfluenzaA__ABU80301

SEQ ID NO: 15887 - protein, 470 aa, Artificial Sequence
  neuraminidase__InfluenzaA__ABU80312
MNTNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVMREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 15888 - protein, 469 aa, Artificial Sequence; identical to SEQ ID NO: 14730
  neuraminidase__InfluenzaA__ABU80323

SEQ ID NO: 15889 - protein, 469 aa, Artificial Sequence
  neuraminidase__InfluenzaA__ABU80334
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKTLRTQESECVCINGTCTVVMTDGSASGKADTKILFIEEGKIIHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15890 - protein, 469 aa, Artificial Sequence; identical to SEQ ID NO: 14154
  neuraminidase__InfluenzaA__ABU92762

SEQ ID NO: 15891 - protein, 469 aa, Artificial Sequence
  neuraminidase__InfluenzaA__ABU92764
MNPNQKIITIGSVSLTIATICFLMQIAILVTTVTLHFKQYECNSPPNNQVMLCEPTIMERNITEIVYLTNTTIEKEICPKLAEYRNWSKPQCNVTGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGKKEETEVWWTSNSIVVFCGTSGTYGTGSWPDGADINLMPI

SEQ ID NO: 15892 - protein, 469 aa, Artificial Sequence; identical to SEQ ID NO: 14154
  neuraminidase__InfluenzaA__ABU92765

SEQ ID NO: 15893 - protein, 469 aa, Artificial Sequence; identical to SEQ ID NO: 14154
  neuraminidase__InfluenzaA__ABU92766

SEQ ID NO: 15894 - protein, 469 aa, Artificial Sequence; identical to SEQ ID NO: 14154
  neuraminidase__InfluenzaA__ABU92767

SEQ ID NO: 15895 - protein, 469 aa, Artificial Sequence; identical to SEQ ID NO: 14154
  neuraminidase__InfluenzaA__ABU92768

SEQ ID NO: 15896 - protein, 469 aa, Artificial Sequence; identical to SEQ ID NO: 14061
  neuraminidase__InfluenzaA__ABU92769

SEQ ID NO: 15897 - protein, 469 aa, Artificial Sequence; identical to SEQ ID NO: 14253
  neuraminidase__InfluenzaA__ABU92770

SEQ ID NO: 15898 - protein, 469 aa, Artificial Sequence
  neuraminidase__InfluenzaA__ABU92771
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPNKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15899 - protein, 469 aa, Artificial Sequence
  neuraminidase__InfluenzaA__ABU92772
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKNILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15900 - protein, 469 aa, Artificial Sequence
  neuraminidase__InfluenzaA__ABU92773
MNPNQKIITIGSVSLTIATICFLMQIAILVTTVTLHFKQYECNSPPNNQVMLCEPTIIERNITETVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15901 - protein, 469 aa, Artificial Sequence
  neuraminidase__InfluenzaA__ABU92774
MNPNRKIITIGSVSLTIATICFLMQIAILVTTVTLHFKQYECNSPPNNQVMLCEPTIIERNITETVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 15902 - protein, 469 aa, Artificial Sequence
  neuraminidase__InfluenzaA__ABU92775
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15903 - protein, 469 aa, Artificial Sequence; identical to SEQ ID NO: 14327
  neuraminidase__InfluenzaA__ABU92777

SEQ ID NO: 15904 - protein, 469 aa, Artificial Sequence
  neuraminidase__InfluenzaA__ABU92778
MNPNQKIITIGSVSLTISTICFFMQIAILITTVTLHFKQYEFNSPPNNQVMLCEPTIIERNITEIVYLTNTTIEKEVCPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15905 - protein, 469 aa, Artificial Sequence; identical to SEQ ID NO: 14225
  neuraminidase__InfluenzaA__ABU92779

SEQ ID NO: 15906 - protein, 469 aa, Artificial Sequence; identical to SEQ ID NO: 14225
  neuraminidase__InfluenzaA__ABU92780

SEQ ID NO: 15907 - protein, 469 aa, Artificial Sequence; identical to SEQ ID NO: 14225
  neuraminidase__InfluenzaA__ABU92781

SEQ ID NO: 15908 - protein, 469 aa, Artificial Sequence
  neuraminidase__InfluenzaA__ABU92782
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRREETEVWWTSNSIVVFCGTSGTYGTGSWPDGADINLMPI

SEQ ID NO: 15909 - protein, 469 aa, Artificial Sequence; identical to SEQ ID NO: 14225
  neuraminidase__InfluenzaA__ABU92783

SEQ ID NO: 15910 - protein, 469 aa, Artificial Sequence; identical to SEQ ID NO: 14225
  neuraminidase__InfluenzaA__ABU92784

SEQ ID NO: 15911 - protein, 469 aa, Artificial Sequence; identical to SEQ ID NO: 14225
  neuraminidase__InfluenzaA__ABU92785

SEQ ID NO: 15912 - protein, 469 aa, Artificial Sequence; identical to SEQ ID NO: 14225
  neuraminidase__InfluenzaA__ABU92786

SEQ ID NO: 15913 - protein, 469 aa, Artificial Sequence
  neuraminidase__InfluenzaA__ABU92787
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRHPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15914 - protein, 469 aa, Artificial Sequence
  neuraminidase__InfluenzaA__ABU92789
MNPNQKIITIGSVSLTISTICFFMQIAILITTVTLHFKQYEFNPPPNNQVMLCEPTIIERNITEIVYLTNTTIEKEICPKLAEYRNWSKPQCSITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15915 - protein, 469 aa, Artificial Sequence; identical to SEQ ID NO: 14327
  neuraminidase__InfluenzaA__ABU92790

SEQ ID NO: 15916 - protein, 469 aa, Artificial Sequence
  neuraminidase__InfluenzaA__ABU92791
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSTVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15917 - protein, 469 aa, Artificial Sequence
  neuraminidase__InfluenzaA__ABU92792
MNPNQKIITIGSVSLTISTICFFMQIAILITTVTLHFKQYVFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKNYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15918 - protein, 469 aa, Artificial Sequence; identical to SEQ ID NO: 14807
  neuraminidase__InfluenzaA__ABU92793

SEQ ID NO: 15919 - protein, 469 aa, Artificial Sequence; identical to SEQ ID NO: 15914
  neuraminidase__InfluenzaA__ABU92794

SEQ ID NO: 15920 - protein, 469 aa, Artificial Sequence; identical to SEQ ID NO: 14225
  neuraminidase__InfluenzaA__ABU92795

SEQ ID NO: 15921 - protein, 469 aa, Artificial Sequence; identical to SEQ ID NO: 14225
  neuraminidase__InfluenzaA__ABU92796

SEQ ID NO: 15922 - protein, 469 aa, Artificial Sequence
  neuraminidase__InfluenzaA__ABU92797
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKRILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTINEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15923 - protein, 469 aa, Artificial Sequence; identical to SEQ ID NO: 14225
  neuraminidase__InfluenzaA__ABU92798

SEQ ID NO: 15924 - protein, 469 aa, Artificial Sequence; identical to SEQ ID NO: 14225
  neuraminidase__InfluenzaA__ABU92799

SEQ ID NO: 15925 - protein, 469 aa, Artificial Sequence; identical to SEQ ID NO: 14225
  neuraminidase__InfluenzaA__ABU92800

SEQ ID NO: 15926 - protein, 469 aa, Artificial Sequence
  neuraminidase__InfluenzaA__ABU92801
MNPNQKIITIGSVSLTIAAICFLMQIAILVTTVTLHFKQHECNSPPNNQVMLCEPTIIERNITEIVHLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15927 - protein, 469 aa, Artificial Sequence; identical to SEQ ID NO: 14225
  neuraminidase__InfluenzaA__ABU92802

SEQ ID NO: 15928 - protein, 469 aa, Artificial Sequence; identical to SEQ ID NO: 14225
  neuraminidase__InfluenzaA__ABU92804

SEQ ID NO: 15929 - protein, 469 aa, Artificial Sequence
  neuraminidase__InfluenzaA__ABU92805
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15930 - protein, 469 aa, Artificial Sequence; identical to SEQ ID NO: 15929
  neuraminidase__InfluenzaA__ABU92806

SEQ ID NO: 15931 - protein, 469 aa, Artificial Sequence
  neuraminidase__InfluenzaA__ABU92808
MNPNQKIITIGSVSLTIATICFLMQITILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIIHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15932 - protein, 469 aa, Artificial Sequence
  neuraminidase__InfluenzaA__ABU92809
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETDVLWTSNSIVVFCGTSGTYGTGSWPDGADINLMPI

SEQ ID NO: 15933 - protein, 469 aa, Artificial Sequence
  neuraminidase__InfluenzaA__ABU92810
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVEGGNRSGYSGIFSVEGKSCINRCFYVELIRGRKEETEVWWTSNSIVVFCGTSGTYGTGSWPDGADINLMPI

SEQ ID NO: 15934 - protein, 469 aa, Artificial Sequence
  neuraminidase__InfluenzaA__ABU92811
MNPNQKIITIGSVSLTIAAICFLMQIAILVTTVTLHFKQHECNSPPNNQVMLCEPTMIERNITEIVYLTNTTIEKEICPKLAEYRNWSKPQCNITGFAPFSKDNSIRLSAVGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15935 - protein, 469 aa, Artificial Sequence; identical to SEQ ID NO: 14225
  neuraminidase__InfluenzaA__ABU92814

SEQ ID NO: 15936 - protein, 469 aa, Artificial Sequence; identical to SEQ ID NO: 14714
  neuraminidase__InfluenzaA__ABU92815

SEQ ID NO: 15937 - protein, 469 aa, Artificial Sequence; identical to SEQ ID NO: 14225
  neuraminidase__InfluenzaA__ABU92816

SEQ ID NO: 15938 - protein, 469 aa, Artificial Sequence
  neuraminidase__InfluenzaA__ABU92817
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVESKSCINRCFYVELIRGRKEETEVWWTSNSIVVFCGTSGTYGTGSWPDGADINLMPI

SEQ ID NO: 15939 - protein, 469 aa, Artificial Sequence; identical to SEQ ID NO: 14225
  neuraminidase__InfluenzaA__ABU92818

SEQ ID NO: 15940 - protein, 469 aa, Artificial Sequence; identical to SEQ ID NO: 14225
  neuraminidase__InfluenzaA__ABU92819

SEQ ID NO: 15941 - protein, 469 aa, Artificial Sequence; identical to SEQ ID NO: 14225
  neuraminidase__InfluenzaA__ABU92821

SEQ ID NO: 15942 - protein, 469 aa, Artificial Sequence; identical to SEQ ID NO: 14225
  neuraminidase__InfluenzaA__ABU92822

SEQ ID NO: 15943 - protein, 469 aa, Artificial Sequence; identical to SEQ ID NO: 14137
  neuraminidase__InfluenzaA__ABU92823

SEQ ID NO: 15944 - protein, 469 aa, Artificial Sequence
  neuraminidase__InfluenzaA__ABU92824
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRRNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15945 - protein, 469 aa, Artificial Sequence
  neuraminidase__InfluenzaA__ABU92825
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15946 - protein, 469 aa, Artificial Sequence; identical to SEQ ID NO: 15945
  neuraminidase__InfluenzaA__ABU92826

SEQ ID NO: 15947 - protein, 469 aa, Artificial Sequence; identical to SEQ ID NO: 14225
  neuraminidase__InfluenzaA__ABU92827

SEQ ID NO: 15948 - protein, 469 aa, Artificial Sequence; identical to SEQ ID NO: 14225
  neuraminidase__InfluenzaA__ABU92828

SEQ ID NO: 15949 - protein, 469 aa, Artificial Sequence; identical to SEQ ID NO: 14714
  neuraminidase__InfluenzaA__ABU92829

SEQ ID NO: 15950 - protein, 469 aa, Artificial Sequence
  neuraminidase__InfluenzaA__ABU92830
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSRCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15951 - protein, 469 aa, Artificial Sequence; identical to SEQ ID NO: 14225
  neuraminidase__InfluenzaA__ABU92831

SEQ ID NO: 15952 - protein, 469 aa, Artificial Sequence; identical to SEQ ID NO: 14225
  neuraminidase__InfluenzaA__ABU92832

SEQ ID NO: 15953 - protein, 469 aa, Artificial Sequence; identical to SEQ ID NO: 14225
  neuraminidase__InfluenzaA__ABU92833

SEQ ID NO: 15954 - protein, 469 aa, Artificial Sequence
  neuraminidase__InfluenzaA__ABU92834
MNPNQKIITIGSVSLTIAAICFLMHIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADISLMPI

SEQ ID NO: 15955 - protein, 469 aa, Artificial Sequence; identical to SEQ ID NO: 14225
  neuraminidase__InfluenzaA__ABU92835

SEQ ID NO: 15956 - protein, 469 aa, Artificial Sequence; identical to SEQ ID NO: 14225
  neuraminidase__InfluenzaA__ABU92836

SEQ ID NO: 15957 - protein, 469 aa, Artificial Sequence
  neuraminidase__InfluenzaA__ABU92837
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIASSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCVNRCFYVELIRGRKEETEVLWTSNSIVVFCGTSGTYGTGSWPDGADINLMPI

SEQ ID NO: 15958 - protein, 469 aa, Artificial Sequence; identical to SEQ ID NO: 14225
  neuraminidase__InfluenzaA__ABU92838

SEQ ID NO: 15959 - protein, 469 aa, Artificial Sequence; identical to SEQ ID NO: 14061
  neuraminidase__InfluenzaA__ABU92839

SEQ ID NO: 15960 - protein, 469 aa, Artificial Sequence
  neuraminidase__InfluenzaA__ABU92840
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHISLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRDNRSGYSGIFSVEGKSCINRCFYVELIRGRKQETEVLWTSNSIVVFCGTSGTYGTGSWPDGADINLMPI

SEQ ID NO: 15961 - protein, 469 aa, Artificial Sequence
  neuraminidase__InfluenzaA__ABU92841
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRDNRSGYSGIFSVEGKSCINRCFYVELIRGRKQETEVLWTSNSIVVFCGTSGTYGTGSWPDGADINLMPI

SEQ ID NO: 15962 - protein, 469 aa, Artificial Sequence
  neuraminidase__InfluenzaA__ABU92842
MNPNQKIITIGSVSLTIATICFLMQIAILVTTVTLHFKQYDCNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 15963 - protein, 469 aa, Artificial Sequence; identical to SEQ ID NO: 14061
  neuraminidase__InfluenzaA__ABU92843

SEQ ID NO: 15964 - protein, 469 aa, Artificial Sequence; identical to SEQ ID NO: 15749
  neuraminidase__InfluenzaA__ABU92844

SEQ ID NO: 15965 - protein, 469 aa, Artificial Sequence; identical to SEQ ID NO: 14061
  neuraminidase__InfluenzaA__ABU92845

SEQ ID NO: 15966 - protein, 469 aa, Artificial Sequence; identical to SEQ ID NO: 14061
  neuraminidase__InfluenzaA__ABU92846

SEQ ID NO: 15967 - protein, 469 aa, Artificial Sequence; identical to SEQ ID NO: 14061
  neuraminidase__InfluenzaA__ABU92847

SEQ ID NO: 15968 - protein, 469 aa, Artificial Sequence; identical to SEQ ID NO: 14061
  neuraminidase__InfluenzaA__ABU92848

SEQ ID NO: 15969 - protein, 469 aa, Artificial Sequence; identical to SEQ ID NO: 14714
  neuraminidase__InfluenzaA__ABU92849

SEQ ID NO: 15970 - protein, 469 aa, Artificial Sequence
  neuraminidase__InfluenzaA__ABU92850
MNPNQKIITIGSVSLTISTICFFMQIAILITTVTLHFKQYEFNSPPNNQVMLCEPTIIERNITEIVYLTNTTIEKEICPKLVEYRNWSKPQCDITGFAPFSKDNSIRLSAGGDIWVTREPYVSCDPDKCYQFALGQGTTLNNVHSNDTVHDRTPYRTLLMTELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEENEVLWTSNSIVVFCGTSGTYGTGSWPDGADINLMPI

SEQ ID NO: 15971 - protein, 469 aa, Artificial Sequence
  neuraminidase__InfluenzaA__ABU92851
MNPNQKIITIGSVSLTISTICFFMQIAILITTVTLHFKQYEFNSPPNNQVMLCEPTIIERNITEIVYLTNTTIEKEICPKLAEYRNWSKPQCSITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKDDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15972 - protein, 469 aa, Artificial Sequence; identical to SEQ ID NO: 14225
  neuraminidase__InfluenzaA__ABU92852

SEQ ID NO: 15973 - protein, 469 aa, Artificial Sequence
  neuraminidase__InfluenzaA__ABU92853
MNPNQKIITIGSVSLTIAAICFLMQIAILVTTVTLHFKQHECNSPPKNQVMLCEPTIIERNITEIVYMTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIVSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15974 - protein, 469 aa, Artificial Sequence; identical to SEQ ID NO: 14225
  neuraminidase__InfluenzaA__ABU92854

SEQ ID NO: 15975 - protein, 469 aa, Artificial Sequence
  neuraminidase__InfluenzaA__ABU92855
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIIERGNRSGYSGIFSVEGKSCINRCFYVELIRGRKEETEVWWTSNSIVVFCGTSGTYGTGSWPDGADINLMPI

SEQ ID NO: 15976 - protein, 469 aa, Artificial Sequence; identical to SEQ ID NO: 14145
  neuraminidase__InfluenzaA__ABU92856

SEQ ID NO: 15977 - protein, 469 aa, Artificial Sequence; identical to SEQ ID NO: 14225
  neuraminidase__InfluenzaA__ABU92857

SEQ ID NO: 15978 - protein, 469 aa, Artificial Sequence
  neuraminidase__InfluenzaA__ABU92858
MNPNQKIITIGSVSLTISTICFFMQIAILITTVTLHFKQYEFNSPPNNQVILCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15979 - protein, 469 aa, Artificial Sequence
  neuraminidase__InfluenzaA__ABU92859
MNPNQKIITIGSVSLTIAAICFLMQIAILVTTVTLHFKQHECNSPPNNQVMLCEPTIIERNITEIVYLTNTTIEKEICPKLAGYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15980 - protein, 469 aa, Artificial Sequence
  neuraminidase__InfluenzaA__ABU92860
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWYKKILRTQESECVCINGTCTVVMTDGSASGKADTKILFIEEGKIVHISTLSGSAQHVEECSCYPRYPGVRCVCRDNWKGSNRPIVDINVKDYSIISSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15981 - protein, 469 aa, Artificial Sequence
  neuraminidase__InfluenzaA__ABU92861
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCMAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15982 - protein, 469 aa, Artificial Sequence
  neuraminidase__InfluenzaA__ABU92862
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSRDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15983 - protein, 469 aa, Artificial Sequence; identical to SEQ ID NO: 14225
  neuraminidase__InfluenzaA__ABU92863

SEQ ID NO: 15984 - protein, 469 aa, Artificial Sequence
  neuraminidase__InfluenzaA__ABU92865
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDLDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15985 - protein, 469 aa, Artificial Sequence
  neuraminidase__InfluenzaA__ABU92866
MNPNQKIITIGSVSLTISTICFFMQIAILITTVTLHFKQYEFNSPPNNQVMLCEPTIIERNITEIVYLTNTTIEKEVCPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSNSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 15986 - protein, 469 aa, Artificial Sequence; identical to SEQ ID NO: 14807
  neuraminidase__InfluenzaA__ABU92867

SEQ ID NO: 15987 - protein, 469 aa, Artificial Sequence; identical to SEQ ID NO: 15914
  neuraminidase__InfluenzaA__ABU92868

SEQ ID NO: 15988 - protein, 469 aa, Artificial Sequence; identical to SEQ ID NO: 14694
  neuraminidase__InfluenzaA__ABU92869

SEQ ID NO: 15989 - protein, 469 aa, Artificial Sequence; identical to SEQ ID NO: 15884
  neuraminidase__InfluenzaA__ABU92870

SEQ ID NO: 15990 - protein, 469 aa, Artificial Sequence
  neuraminidase__InfluenzaA__ABU92872
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYNIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 15991 - protein, 469 aa, Artificial Sequence
  neuraminidase__InfluenzaA__ABU92873
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINIMPI

SEQ ID NO: 15992 - protein, 469 aa, Artificial Sequence; identical to SEQ ID NO: 15929
  neuraminidase__InfluenzaA__ABU92874

SEQ ID NO: 15993 - protein, 469 aa, Artificial Sequence; identical to SEQ ID NO: 14225
  neuraminidase__InfluenzaA__ABU92875

SEQ ID NO: 15994 - protein, 469 aa, Artificial Sequence; identical to SEQ ID NO: 14225
  neuraminidase__InfluenzaA__ABU92876

SEQ ID NO: 15995 - protein, 469 aa, Artificial Sequence; identical to SEQ ID NO: 14145
  neuraminidase__InfluenzaA__ABU92877

SEQ ID NO: 15996 - protein, 469 aa, Artificial Sequence; identical to SEQ ID NO: 14225
  neuraminidase__InfluenzaA__ABU92878

SEQ ID NO: 15997 - protein, 469 aa, Artificial Sequence
  neuraminidase__InfluenzaA__ABU92879
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKGETEVWWTSNSIVVFCGTSGTYGTGSWPDGADINLMPI

SEQ ID NO: 15998 - protein, 469 aa, Artificial Sequence; identical to SEQ ID NO: 15990
  neuraminidase__InfluenzaA__ABU92880

SEQ ID NO: 15999 - protein, 469 aa, Artificial Sequence; identical to SEQ ID NO: 14225
  neuraminidase__InfluenzaA__ABU92881

SEQ ID NO: 16000 - protein, 469 aa, Artificial Sequence; identical to SEQ ID NO: 14225
  neuraminidase__InfluenzaA__ABU92882

SEQ ID NO: 16001 - protein, 469 aa, Artificial Sequence
  neuraminidase__InfluenzaA__ABU92883
MNPNQKIITIGSVSLTIAAICFLMQIAILVTTVTLHFKQHECNSPPKNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIVSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 16002 - protein, 469 aa, Artificial Sequence; identical to SEQ ID NO: 14225
  neuraminidase__InfluenzaA__ABU92884

SEQ ID NO: 16003 - protein, 469 aa, Artificial Sequence; identical to SEQ ID NO: 14225
  neuraminidase__InfluenzaA__ABU92885

SEQ ID NO: 16004 - protein, 469 aa, Artificial Sequence; identical to SEQ ID NO: 14714
  neuraminidase__InfluenzaA__ABU92886

SEQ ID NO: 16005 - protein, 469 aa, Artificial Sequence; identical to SEQ ID NO: 14225
  neuraminidase__InfluenzaA__ABU92887

SEQ ID NO: 16006 - protein, 469 aa, Artificial Sequence
  neuraminidase__InfluenzaA__ABU92888
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIISSYVCSGLVGDTPRKNDSSSSSHCLDPNNEEGGHGVKGWAFDDGNDVWMGRTISEKLRSGYETFKVVEGWSNPNSKLQINRQVIVDRDNRSGYSGIFSVEGKSCINRCFYVELIRGRNQETEVLWTSNSIVVFCGTSGTYGTGSWPDGADINLMPI

SEQ ID NO: 16007 - protein, 469 aa, Artificial Sequence; identical to SEQ ID NO: 15929
  neuraminidase__InfluenzaA__ABU92889

SEQ ID NO: 16008 - protein, 469 aa, Artificial Sequence
  neuraminidase__InfluenzaA__ABU92890
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELVRGRKEETEVWWTSNSIVVFCGTSGTYGTGSWPDGADINLMPI

SEQ ID NO: 16009 - protein, 469 aa, Artificial Sequence; identical to SEQ ID NO: 15945
  neuraminidase__InfluenzaA__ABU92891

SEQ ID NO: 16010 - protein, 469 aa, Artificial Sequence
  neuraminidase__InfluenzaA__ABU92892
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGNIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16011 - protein, 469 aa, Artificial Sequence; identical to SEQ ID NO: 14807
  neuraminidase__InfluenzaA__ABU92893

SEQ ID NO: 16012 - protein, 469 aa, Artificial Sequence
  neuraminidase__InfluenzaA__ABU92895
MNPNQKIITVGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIASSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16013 - protein, 469 aa, Artificial Sequence
  neuraminidase__InfluenzaA__ABU92896
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGNDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDRNDVWMGRTISEKSRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16014 - protein, 469 aa, Artificial Sequence
  neuraminidase__InfluenzaA__ABU92897
MNPNQKIITIGSVSLTISTICFFMQIAILITTVTLHFKQYELNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16015 - protein, 469 aa, Artificial Sequence
  neuraminidase__InfluenzaA__ABU92898
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKNYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRTGYSGIFSVEGKSCINRCFYVELIRGRKEETEVLWTSNSIVVFCGTSGTYGTGSWPDGADINLMPI

SEQ ID NO: 16016 - protein, 469 aa, Artificial Sequence; identical to SEQ ID NO: 14225
  neuraminidase__InfluenzaA__ABU92899

SEQ ID NO: 16017 - protein, 469 aa, Artificial Sequence
  neuraminidase__InfluenzaA__ABU92900
MNPNQKIITIGSVSLTIAAICFLMQIAILVTTVTLHFKQHECNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 16018 - protein, 469 aa, Artificial Sequence
  neuraminidase__InfluenzaA__ABU92901
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSISSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 16019 - protein, 469 aa, Artificial Sequence; identical to SEQ ID NO: 14225
  neuraminidase__InfluenzaA__ABU92902

SEQ ID NO: 16020 - protein, 469 aa, Artificial Sequence; identical to SEQ ID NO: 14225
  neuraminidase__InfluenzaA__ABU92903

SEQ ID NO: 16021 - protein, 469 aa, Artificial Sequence; identical to SEQ ID NO: 15180
  neuraminidase__InfluenzaA__ABU92904

SEQ ID NO: 16022 - protein, 469 aa, Artificial Sequence; identical to SEQ ID NO: 14225
  neuraminidase__InfluenzaA__ABU92905

SEQ ID NO: 16023 - protein, 469 aa, Artificial Sequence
  neuraminidase__InfluenzaA__ABU92906
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADIKLMPI

SEQ ID NO: 16024 - protein, 469 aa, Artificial Sequence
  neuraminidase__InfluenzaA__ABU92907
MNPNQKIITIGSISLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 16025 - protein, 469 aa, Artificial Sequence; identical to SEQ ID NO: 14225
  neuraminidase__InfluenzaA__ABU92908

SEQ ID NO: 16026 - protein, 469 aa, Artificial Sequence; identical to SEQ ID NO: 14225
  neuraminidase__InfluenzaA__ABU92909

SEQ ID NO: 16027 - protein, 469 aa, Artificial Sequence
  neuraminidase__InfluenzaA__ABU92910
MNPNQKIITIGSVSLTIATICFLTQIAILITTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVRDYSIVSSYVCSGLVGDTPRKNDSSSSSHCLDPNNEEGGHGVKGWAFDDGNDVWMGRTISEKLRSGYETFKVIEGWSKPNSKLQINRQVIVDKGNRSGYSGIFSVEGKSCINRCFYVELIRGRNQETEVLWTSNSIVVFCGTSGTYGTGSWPDGADINLMPI

SEQ ID NO: 16028 - protein, 469 aa, Artificial Sequence
  neuraminidase__InfluenzaA__ABU92911
MNPNQKIITIGSVSLTIATICFLTQIAILVTTVTLHFKQYECNSPPNNQVMLCEPTIIERNITEIVYLTNTTIEKEICPKQAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIKEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRDNRSGYSGIFSVEGKSCINRCFYVELIRGRNQETEVLWTSNSIVVFCGTSGTYGTGSWPDGADINLMPI

SEQ ID NO: 16029 - protein, 469 aa, Artificial Sequence
  neuraminidase__InfluenzaA__ABU92913
MNPNQKIITIGSVSLTIATICFLTQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIKEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRDNRSGYSGIFSVEGKSCINRCFYVELIRGRNQETEVLWTSNSIVVFCGTSGTYGTGSWPDGADINLMPI

SEQ ID NO: 16030 - protein, 470 aa, Artificial Sequence
  neuraminidase__InfluenzaA__ABV29560
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16031 - protein, 470 aa, Artificial Sequence; identical to SEQ ID NO: 16030
  neuraminidase__InfluenzaA__ABV29571

SEQ ID NO: 16032 - protein, 470 aa, Artificial Sequence; identical to SEQ ID NO: 16030
  neuraminidase__InfluenzaA__ABV29582

SEQ ID NO: 16033 - protein, 470 aa, Artificial Sequence; identical to SEQ ID NO: 16030
  neuraminidase__InfluenzaA__ABV29615

SEQ ID NO: 16034 - protein, 470 aa, Artificial Sequence
  neuraminidase__InfluenzaA__ABV29637
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGTASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAISDWSGYSGSFVQHPELTGLDCIRPCFWVELVRGLPRENTTIWTSGSSISFCGVDSDTANWSWPDGAELPFTIDK

SEQ ID NO: 16035 - protein, 470 aa, Artificial Sequence; identical to SEQ ID NO: 16030
  neuraminidase__InfluenzaA__ABV29648

SEQ ID NO: 16036 - protein, 470 aa, Artificial Sequence; identical to SEQ ID NO: 16030
  neuraminidase__InfluenzaA__ABV29659

SEQ ID NO: 16037 - protein, 470 aa, Artificial Sequence; identical to SEQ ID NO: 16030
  neuraminidase__InfluenzaA__ABV29670

SEQ ID NO: 16038 - protein, 470 aa, Artificial Sequence
  neuraminidase__InfluenzaA__ABV29681
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGIDSDTANWSWPDGAELPFTIDK

SEQ ID NO: 16039 - protein, 470 aa, Artificial Sequence; identical to SEQ ID NO: 16030
  neuraminidase__InfluenzaA__ABV29692

SEQ ID NO: 16040 - protein, 470 aa, Artificial Sequence; identical to SEQ ID NO: 16030
  neuraminidase__InfluenzaA__ABV29703

SEQ ID NO: 16041 - protein, 469 aa, Artificial Sequence
  neuraminidase__InfluenzaA__ABV29714
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16042 - protein, 469 aa, Artificial Sequence
  neuraminidase__InfluenzaA__ABV29725
MNPNQKIITIGSVSLTISTICFFMQTAILITTVTLHFKQYEFNSPPNNQGMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCFPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16043 - protein, 470 aa, Artificial Sequence
  neuraminidase__InfluenzaA__ABV29736
MNPNQKIITIGSISIAIGIISLMLQIGNIISIWASHSIQTGSQNHTGICNQRIITYENSTWVNHTYVNINNTNVVTGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSDGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNKLRKGFEMIWDPNGWTDTDNDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16044 - protein, 470 aa, Artificial Sequence
  neuraminidase__InfluenzaA__ABV29747
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVRQDVVAITDWSGYSGSFVQHPELTGLDCIRPCFWVELVRGLPRENTTIWTSGSSISFCGVDSDTANWSWPDGAELPFTIDK

SEQ ID NO: 16045 - protein, 470 aa, Artificial Sequence; identical to SEQ ID NO: 16030
  neuraminidase__InfluenzaA__ABV29769

SEQ ID NO: 16046 - protein, 470 aa, Artificial Sequence
  neuraminidase__InfluenzaA__ABV29780
MNPNQKIITIGSISIAIGIISLMLQIGNIISIWASHSIQTGSQNHTGICNQRIITYENSTWVNHTYVNINNTNVVTGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSDGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSSKLRKGFEMIWDPNGWTDTDNDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16047 - protein, 470 aa, Artificial Sequence; identical to SEQ ID NO: 16030
  neuraminidase__InfluenzaA__ABV29791

SEQ ID NO: 16048 - protein, 470 aa, Artificial Sequence; identical to SEQ ID NO: 16030
  neuraminidase__InfluenzaA__ABV29802

SEQ ID NO: 16049 - protein, 469 aa, Artificial Sequence; identical to SEQ ID NO: 15884
  neuraminidase__InfluenzaA__ABV29824

SEQ ID NO: 16050 - protein, 470 aa, Artificial Sequence; identical to SEQ ID NO: 16030
  neuraminidase__InfluenzaA__ABV29835

SEQ ID NO: 16051 - protein, 470 aa, Artificial Sequence
  neuraminidase__InfluenzaA__ABV29846
MNPNQKIITIGSISIAIGIISLMLQIGNIISIWASHSIQIGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16052 - protein, 470 aa, Artificial Sequence
  neuraminidase__InfluenzaA__ABV29879
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFIIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16053 - protein, 470 aa, Artificial Sequence; identical to SEQ ID NO: 16030
  neuraminidase__InfluenzaA__ABV29890

SEQ ID NO: 16054 - protein, 469 aa, Artificial Sequence; identical to SEQ ID NO: 15884
  neuraminidase__InfluenzaA__ABV29901

SEQ ID NO: 16055 - protein, 469 aa, Artificial Sequence
  neuraminidase__InfluenzaA__ABV29912
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKDILRTQESECICINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQINRQVIVDKGNRSGYSGIFSVEGKSCINRCFYVELIRGRKEETEVLWTSNSIVVFCGTSGTYGTGSWPDGADINLMPI

SEQ ID NO: 16056 - protein, 470 aa, Artificial Sequence
  neuraminidase__InfluenzaA__ABV29923
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENATIWTSGSSISFCGVDSDTANWSWPDGAELPFTIDK

SEQ ID NO: 16057 - protein, 469 aa, Artificial Sequence
  neuraminidase__InfluenzaA__ABV29934
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRTGYSGIFSVEGKSCINRCFYVELIRGRKEETEVLWTSNSIVVFCGTSGTYGTGSWPDGADINLMPI

SEQ ID NO: 16058 - protein, 470 aa, Artificial Sequence; identical to SEQ ID NO: 16043
  neuraminidase__InfluenzaA__ABV29945

SEQ ID NO: 16059 - protein, 470 aa, Artificial Sequence
  neuraminidase__InfluenzaA__ABV29956
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYKGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16060 - protein, 470 aa, Artificial Sequence
  neuraminidase__InfluenzaA__ABV29989
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVMREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16061 - protein, 470 aa, Artificial Sequence; identical to SEQ ID NO: 16030
  neuraminidase__InfluenzaA__ABV30000

SEQ ID NO: 16062 - protein, 470 aa, Artificial Sequence; identical to SEQ ID NO: 16030
  neuraminidase__InfluenzaA__ABV30011

SEQ ID NO: 16063 - protein, 470 aa, Artificial Sequence; identical to SEQ ID NO: 16030
  neuraminidase__InfluenzaA__ABV30022

SEQ ID NO: 16064 - protein, 470 aa, Artificial Sequence
  neuraminidase__InfluenzaA__ABV30044
MNPNQKIITIGSISIAIGIISLMLQIGNIISIWASHSIQTGSQNHTGICNQRIITYENSTWVNHTYVNINNTNVVAGKDKTSGTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16065 - protein, 470 aa, Artificial Sequence
  neuraminidase__InfluenzaA__ABV30055
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16066 - protein, 469 aa, Artificial Sequence
  neuraminidase__InfluenzaA__ABV30077
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16067 - protein, 470 aa, Artificial Sequence; identical to SEQ ID NO: 16030
  neuraminidase__InfluenzaA__ABV30088

SEQ ID NO: 16068 - protein, 470 aa, Artificial Sequence; identical to SEQ ID NO: 16030
  neuraminidase__InfluenzaA__ABV30099

SEQ ID NO: 16069 - protein, 470 aa, Artificial Sequence
  neuraminidase__InfluenzaA__ABV30110
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16070 - protein, 470 aa, Artificial Sequence; identical to SEQ ID NO: 16030
  neuraminidase__InfluenzaA__ABV30132

SEQ ID NO: 16071 - protein, 470 aa, Artificial Sequence
  neuraminidase__InfluenzaA__ABV30143
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16072 - protein, 470 aa, Artificial Sequence; identical to SEQ ID NO: 16056
  neuraminidase__InfluenzaA__ABV30154

SEQ ID NO: 16073 - protein, 470 aa, Artificial Sequence
  neuraminidase__InfluenzaA__ABV30165
MNPNQKIITIGSISIAIGIISLMLQIGNIISIWASHSIQTGSQNHTGICNQRIITYENSTWVNHTYVSINNTNVVAGKDKTSVTLAGNLSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16074 - protein, 470 aa, Artificial Sequence; identical to SEQ ID NO: 16030
  neuraminidase__InfluenzaA__ABV30187

SEQ ID NO: 16075 - protein, 470 aa, Artificial Sequence; identical to SEQ ID NO: 16030
  neuraminidase__InfluenzaA__ABV30198

SEQ ID NO: 16076 - protein, 469 aa, Artificial Sequence; identical to SEQ ID NO: 15884
  neuraminidase__InfluenzaA__ABV30209

SEQ ID NO: 16077 - protein, 469 aa, Artificial Sequence; identical to SEQ ID NO: 16066
  neuraminidase__InfluenzaA__ABV30220

SEQ ID NO: 16078 - protein, 469 aa, Artificial Sequence; identical to SEQ ID NO: 16066
  neuraminidase__InfluenzaA__ABV30231

SEQ ID NO: 16079 - protein, 469 aa, Artificial Sequence
  neuraminidase__InfluenzaA__ABV30264
MNPNQKIITIGSVSLTISTICFFMQIAILITTVTLHFKQYEFSSPPNNQVMLCEPTIIERNITEVVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16080 - protein, 469 aa, Artificial Sequence
  neuraminidase__InfluenzaA__ABV30275
MNPNQKIITIGSVSLTISTICFFMQTAILITTVTLHFKQYEFNSTPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16081 - protein, 470 aa, Artificial Sequence; identical to SEQ ID NO: 16071
  neuraminidase__InfluenzaA__ABV30297

SEQ ID NO: 16082 - protein, 470 aa, Artificial Sequence
  neuraminidase__InfluenzaA__ABV30308
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCLNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16083 - protein, 470 aa, Artificial Sequence
  neuraminidase__InfluenzaA__ABV30319
MNPNQKIITIGSISIAIGIISLMLQIGNIVSIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16084 - protein, 470 aa, Artificial Sequence; identical to SEQ ID NO: 16071
  neuraminidase__InfluenzaA__ABV30330

SEQ ID NO: 16085 - protein, 470 aa, Artificial Sequence; identical to SEQ ID NO: 16030
  neuraminidase__InfluenzaA__ABV30341

SEQ ID NO: 16086 - protein, 470 aa, Artificial Sequence; identical to SEQ ID NO: 16030
  neuraminidase__InfluenzaA__ABV30363

SEQ ID NO: 16087 - protein, 470 aa, Artificial Sequence; identical to SEQ ID NO: 16030
  neuraminidase__InfluenzaA__ABV30374

SEQ ID NO: 16088 - protein, 469 aa, Artificial Sequence
  neuraminidase__InfluenzaA__ABV30385
MNPNQKIITIGSVSLTISTICFFMQIAILITTVTLHFKQYEFSPPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16089 - protein, 469 aa, Artificial Sequence
  neuraminidase__InfluenzaA__ABV30396
MNPNQKIITIGSVSLTISTICFFMQIAILITTVTLHFKQYEFNSSPNNQVMLCEPTIIERNITEIVYLTNTTIEKEICPKLSEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEENEVLWTSNSIVVFCGTSGTYGTGSWPDGADINLMPI

SEQ ID NO: 16090 - protein, 469 aa, Artificial Sequence
  neuraminidase__InfluenzaA__ABV30407
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16091 - protein, 469 aa, Artificial Sequence
  neuraminidase__InfluenzaA__ABV30418
MNPNQKIITIGSVSLTISTICFFMQIAILITTVTLHFKQYEFSSLPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRREETEVLWTSNSIVVFCGTSGTYGTGSWPDGADINLMPI

SEQ ID NO: 16092 - protein, 469 aa, Artificial Sequence; identical to SEQ ID NO: 16057
  neuraminidase__InfluenzaA__ABV30429

SEQ ID NO: 16093 - protein, 469 aa, Artificial Sequence; identical to SEQ ID NO: 16057
  neuraminidase__InfluenzaA__ABV30440

SEQ ID NO: 16094 - protein, 469 aa, Artificial Sequence; identical to SEQ ID NO: 16057
  neuraminidase__InfluenzaA__ABV30451

SEQ ID NO: 16095 - protein, 470 aa, Artificial Sequence; identical to SEQ ID NO: 16030
  neuraminidase__InfluenzaA__ABV30462

SEQ ID NO: 16096 - protein, 469 aa, Artificial Sequence; identical to SEQ ID NO: 16057
  neuraminidase__InfluenzaA__ABV30473

SEQ ID NO: 16097 - protein, 469 aa, Artificial Sequence
  neuraminidase__InfluenzaA__ABV30484
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSNSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16098 - protein, 470 aa, Artificial Sequence; identical to SEQ ID NO: 16069
  neuraminidase__InfluenzaA__ABV30495

SEQ ID NO: 16099 - protein, 470 aa, Artificial Sequence; identical to SEQ ID NO: 16030
  neuraminidase__InfluenzaA__ABV30506

SEQ ID NO: 16100 - protein, 469 aa, Artificial Sequence; identical to SEQ ID NO: 16066
  neuraminidase__InfluenzaA__ABV30517

SEQ ID NO: 16101 - protein, 470 aa, Artificial Sequence
  neuraminidase__InfluenzaA__ABV30528
MNSNQKIITIGSISIAIGIISLMLQIGNIISMWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENATIWTSGSSISFCGVDSDTANWSWPDGAELPFTIDK

SEQ ID NO: 16102 - protein, 470 aa, Artificial Sequence; identical to SEQ ID NO: 16030
  neuraminidase__InfluenzaA__ABV30539

SEQ ID NO: 16103 - protein, 470 aa, Artificial Sequence; identical to SEQ ID NO: 16030
  neuraminidase__InfluenzaA__ABV30561

SEQ ID NO: 16104 - protein, 470 aa, Artificial Sequence; identical to SEQ ID NO: 16030
  neuraminidase__InfluenzaA__ABV30572

SEQ ID NO: 16105 - protein, 470 aa, Artificial Sequence; identical to SEQ ID NO: 16030
  neuraminidase__InfluenzaA__ABV30583

SEQ ID NO: 16106 - protein, 470 aa, Artificial Sequence; identical to SEQ ID NO: 16030
  neuraminidase__InfluenzaA__ABV30594

SEQ ID NO: 16107 - protein, 470 aa, Artificial Sequence
  neuraminidase__InfluenzaA__ABV30605
MNPNQKIITIGSISIAIGIISLMLQIGNIISIWASHSIQTGSQNHTGICNQRIITYENSTWVNHTYVSINNTNVVVGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16108 - protein, 470 aa, Artificial Sequence; identical to SEQ ID NO: 16030
  neuraminidase__InfluenzaA__ABV30616

SEQ ID NO: 16109 - protein, 470 aa, Artificial Sequence; identical to SEQ ID NO: 16030
  neuraminidase__InfluenzaA__ABV30627

SEQ ID NO: 16110 - protein, 469 aa, Artificial Sequence
  neuraminidase__InfluenzaA__ABV30649
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGNADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16111 - protein, 469 aa, Artificial Sequence; identical to SEQ ID NO: 15884
  neuraminidase__InfluenzaA__ABV30660

SEQ ID NO: 16112 - protein, 470 aa, Artificial Sequence
  neuraminidase__InfluenzaA__ABV45852
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPNNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 16113 - protein, 469 aa, Artificial Sequence; identical to SEQ ID NO: 15884
  neuraminidase__InfluenzaA__ABV45863

SEQ ID NO: 16114 - protein, 470 aa, Artificial Sequence
  neuraminidase__InfluenzaA__ABV45874
MNPNQKIITIGSISIAIGIISLMLQIGNIISIWASYSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16115 - protein, 470 aa, Artificial Sequence; identical to SEQ ID NO: 16030
  neuraminidase__InfluenzaA__ABV45885

SEQ ID NO: 16116 - protein, 470 aa, Artificial Sequence; identical to SEQ ID NO: 16043
  neuraminidase__InfluenzaA__ABV45896

SEQ ID NO: 16117 - protein, 470 aa, Artificial Sequence; identical to SEQ ID NO: 16030
  neuraminidase__InfluenzaA__ABV45918

SEQ ID NO: 16118 - protein, 470 aa, Artificial Sequence
  neuraminidase__InfluenzaA__ABV45929
MNPNQKIITIGSISIAIGIISLMLQIGNIISMWASHSIQTGSQNHTGICNQRIITYENSTWVNHTYVNINNTNVVTGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSDGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNKLRKGFEMIWDPNGWTDTDNDFSVKQDVVAITDWSGYSGSFVQHPELTGLDCIRPCFWVELVRGLPRENATIWTSGSSISFCGVDSDTANWSWPDGAELPFTIDK

SEQ ID NO: 16119 - protein, 470 aa, Artificial Sequence
  neuraminidase__InfluenzaA__ABV45940
MNPNQKIITIGSISIAIGIISLMLQIGNIISIWASHSIQTGSQNHTGICNQRIIRYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQSLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16120 - protein, 470 aa, Artificial Sequence; identical to SEQ ID NO: 16056
  neuraminidase__InfluenzaA__ABV45951

SEQ ID NO: 16121 - protein, 469 aa, Artificial Sequence
  neuraminidase__InfluenzaA__ABV45973
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETDVLWTSNSIVVFCGTSGTYGTGSWPDGADINLMPI

SEQ ID NO: 16122 - protein, 469 aa, Artificial Sequence
  neuraminidase__InfluenzaA__ABV45984
MNPNQKIITIGSVSLTISTICFFMQIAILVTTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16123 - protein, 469 aa, Artificial Sequence; identical to SEQ ID NO: 15884
  neuraminidase__InfluenzaA__ABV45995

SEQ ID NO: 16124 - protein, 470 aa, Artificial Sequence; identical to SEQ ID NO: 16043
  neuraminidase__InfluenzaA__ABV82554

SEQ ID NO: 16125 - protein, 469 aa, Artificial Sequence; identical to SEQ ID NO: 16066
  neuraminidase__InfluenzaA__ABV82565

SEQ ID NO: 16126 - protein, 469 aa, Artificial Sequence; identical to SEQ ID NO: 16066
  neuraminidase__InfluenzaA__ABW36171

SEQ ID NO: 16127 - protein, 470 aa, Artificial Sequence; identical to SEQ ID NO: 16082
  neuraminidase__InfluenzaA__ABW36193

SEQ ID NO: 16128 - protein, 470 aa, Artificial Sequence; identical to SEQ ID NO: 16030
  neuraminidase__InfluenzaA__ABW36204

SEQ ID NO: 16129 - protein, 470 aa, Artificial Sequence
  neuraminidase__InfluenzaA__ABW36215
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGKGWLTIGISGPDNGAVAVLKYNGIITETIKSWNKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGRGSCNPVTVDGADGVKGFSYKYGNGVWIGRTKSNRLRKGFEMIWDPNGWTDTDSHFSVKQDVVAITDWSGYSGSFVQHPELTGLDCIKPCFWVELVRGLPRENTTIWTSGSSISFCGVDSDTANWSWPDGAELPFIIDK

SEQ ID NO: 16130 - protein, 470 aa, Artificial Sequence; identical to SEQ ID NO: 16030
  neuraminidase__InfluenzaA__ABW36226

SEQ ID NO: 16131 - protein, 470 aa, Artificial Sequence
  neuraminidase__InfluenzaA__ABW36237
MNPNQKIITIGSISITIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16132 - protein, 470 aa, Artificial Sequence; identical to SEQ ID NO: 16030
  neuraminidase__InfluenzaA__ABW36248

SEQ ID NO: 16133 - protein, 470 aa, Artificial Sequence
  neuraminidase__InfluenzaA__ABW36259
MNPNQKIITIGSISIAIGIISLMLQIGNIISIWASHSIQTGSQNNTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNRAASYKIFKIEKGKVTKSIELNAPNFHYEECSCYPDTGIVMCVCRDNWHGSNRPWVSFNQNLDYQIGYICSGVLGDNPRPEDGEGSCNPVTVDGADGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVSSDTANWSWPDGAELPFTIDK

SEQ ID NO: 16134 - protein, 470 aa, Artificial Sequence; identical to SEQ ID NO: 16030
  neuraminidase__InfluenzaA__ABW36281

SEQ ID NO: 16135 - protein, 470 aa, Artificial Sequence; identical to SEQ ID NO: 16030
  neuraminidase__InfluenzaA__ABW36292

SEQ ID NO: 16136 - protein, 470 aa, Artificial Sequence; identical to SEQ ID NO: 16043
  neuraminidase__InfluenzaA__ABW36303

SEQ ID NO: 16137 - protein, 470 aa, Artificial Sequence
  neuraminidase__InfluenzaA__ABW36314
MNPNQKIITIGSICMAIGIISLILQIGNIISIWVSHSIQTGSQNHTGICNQRIITYENSTWVNQTYVNISNTNVVAGKDTTSMTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKQILRTQESECVCVNGSCFTIMTDGPSDGQASYRIFKIEKGKITKSIELDAPNFHYEECSCYPDTGTVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 16138 - protein, 469 aa, Artificial Sequence
  neuraminidase__InfluenzaA__ABW38366
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIASWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16139 - protein, 470 aa, Artificial Sequence; identical to SEQ ID NO: 16129
  neuraminidase__InfluenzaA__ABW39780

SEQ ID NO: 16140 - protein, 470 aa, Artificial Sequence
  neuraminidase__InfluenzaA__ABW39809
MNPNQKIITIGSISIAIGIISLMLQIGNIISIWASHSIQTGSQNHTGICNQRIITYENSTWVNHTYVSINNTNVVAGKDKTLVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16141 - protein, 470 aa, Artificial Sequence; identical to SEQ ID NO: 16043
  neuraminidase__InfluenzaA__ABW39820

SEQ ID NO: 16142 - protein, 470 aa, Artificial Sequence
  neuraminidase__InfluenzaA__ABW39831
MNPNQKIITIGSISIAIGIISLMLQIGNIISIWASHSIQTGSQNHTGICNQRIITYENSTWVNHTYVNINNTNVVAGKDKTPVTLVGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYNGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNGDIANWSWPDGAELPFTIDK

SEQ ID NO: 16143 - protein, 470 aa, Artificial Sequence; identical to SEQ ID NO: 16056
  neuraminidase__InfluenzaA__ABW39842

SEQ ID NO: 16144 - protein, 470 aa, Artificial Sequence; identical to SEQ ID NO: 16030
  neuraminidase__InfluenzaA__ABW39864

SEQ ID NO: 16145 - protein, 469 aa, Artificial Sequence; identical to SEQ ID NO: 16066
  neuraminidase__InfluenzaA__ABW39875

SEQ ID NO: 16146 - protein, 470 aa, Artificial Sequence
  neuraminidase__InfluenzaA__ABW39886
MNPNQKIITIGSISIAIGIISLILQIGNIISIWASHSIQTRNQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16147 - protein, 470 aa, Artificial Sequence; identical to SEQ ID NO: 16030
  neuraminidase__InfluenzaA__ABW39897

SEQ ID NO: 16148 - protein, 470 aa, Artificial Sequence
  neuraminidase__InfluenzaA__ABW39908
MNPNQKIITIGSISIAIGITSLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16149 - protein, 470 aa, Artificial Sequence
  neuraminidase__InfluenzaA__ABW39930
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSDGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16150 - protein, 470 aa, Artificial Sequence
  neuraminidase__InfluenzaA__ABW39952
MNPNQKIITIGSISITIGIISLMLQIGNIISIWASHSIQTGSQNHTGMCNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16151 - protein, 470 aa, Artificial Sequence; identical to SEQ ID NO: 16030
  neuraminidase__InfluenzaA__ABW39963

SEQ ID NO: 16152 - protein, 470 aa, Artificial Sequence; identical to SEQ ID NO: 16030
  neuraminidase__InfluenzaA__ABW39985

SEQ ID NO: 16153 - protein, 470 aa, Artificial Sequence
  neuraminidase__InfluenzaA__ABW39996
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGTASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16154 - protein, 470 aa, Artificial Sequence; identical to SEQ ID NO: 16030
  neuraminidase__InfluenzaA__ABW40007

SEQ ID NO: 16155 - protein, 470 aa, Artificial Sequence
  neuraminidase__InfluenzaA__ABW40018
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGIKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVDGDTANWSWPDGAELPFTIDK

SEQ ID NO: 16156 - protein, 469 aa, Artificial Sequence; identical to SEQ ID NO: 15884
  neuraminidase__InfluenzaA__ABW40029

SEQ ID NO: 16157 - protein, 470 aa, Artificial Sequence
  neuraminidase__InfluenzaA__ABW40040
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGIWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16158 - protein, 470 aa, Artificial Sequence; identical to SEQ ID NO: 16030
  neuraminidase__InfluenzaA__ABW40051

SEQ ID NO: 16159 - protein, 470 aa, Artificial Sequence; identical to SEQ ID NO: 16030
  neuraminidase__InfluenzaA__ABW40062

SEQ ID NO: 16160 - protein, 469 aa, Artificial Sequence; identical to SEQ ID NO: 16066
  neuraminidase__InfluenzaA__ABW40084

SEQ ID NO: 16161 - protein, 470 aa, Artificial Sequence
  neuraminidase__InfluenzaA__ABW40095
MNPNQKIITIGSISVAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPMTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16162 - protein, 470 aa, Artificial Sequence
  neuraminidase__InfluenzaA__ABW40106
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCLNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMVWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16163 - protein, 470 aa, Artificial Sequence; identical to SEQ ID NO: 16030
  neuraminidase__InfluenzaA__ABW40117

SEQ ID NO: 16164 - protein, 470 aa, Artificial Sequence; identical to SEQ ID NO: 16030
  neuraminidase__InfluenzaA__ABW40128

SEQ ID NO: 16165 - protein, 469 aa, Artificial Sequence; identical to SEQ ID NO: 15884
  neuraminidase__InfluenzaA__ABW40139

SEQ ID NO: 16166 - protein, 470 aa, Artificial Sequence; identical to SEQ ID NO: 16030
  neuraminidase__InfluenzaA__ABW40150

SEQ ID NO: 16167 - protein, 470 aa, Artificial Sequence; identical to SEQ ID NO: 16030
  neuraminidase__InfluenzaA__ABW40161

SEQ ID NO: 16168 - protein, 469 aa, Artificial Sequence
  neuraminidase__InfluenzaA__ABW40172
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELTRGRKEETEVLWTSNSIVVFCGTSGTYGTGSWPDGADINLMPI

SEQ ID NO: 16169 - protein, 470 aa, Artificial Sequence; identical to SEQ ID NO: 16030
  neuraminidase__InfluenzaA__ABW40183

SEQ ID NO: 16170 - protein, 469 aa, Artificial Sequence; identical to SEQ ID NO: 15884
  neuraminidase__InfluenzaA__ABW40194

SEQ ID NO: 16171 - protein, 470 aa, Artificial Sequence; identical to SEQ ID NO: 16065
  neuraminidase__InfluenzaA__ABW40205

SEQ ID NO: 16172 - protein, 470 aa, Artificial Sequence; identical to SEQ ID NO: 16069
  neuraminidase__InfluenzaA__ABW40216

SEQ ID NO: 16173 - protein, 470 aa, Artificial Sequence; identical to SEQ ID NO: 16069
  neuraminidase__InfluenzaA__ABW40227

SEQ ID NO: 16174 - protein, 470 aa, Artificial Sequence; identical to SEQ ID NO: 16030
  neuraminidase__InfluenzaA__ABW40238

SEQ ID NO: 16175 - protein, 469 aa, Artificial Sequence
  neuraminidase__InfluenzaA__ABW40249
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADINLMPI

SEQ ID NO: 16176 - protein, 470 aa, Artificial Sequence; identical to SEQ ID NO: 16030
  neuraminidase__InfluenzaA__ABW40260

SEQ ID NO: 16177 - protein, 469 aa, Artificial Sequence
  neuraminidase__InfluenzaA__ABW40271
MNPNQKIITIGSVSLTISTICFFMQIAILITTVTLHFKQYEFNSPPNNQVMLCEPTIIERNITEIVYLTNTTIEKEICPKLAEHRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16178 - protein, 470 aa, Artificial Sequence; identical to SEQ ID NO: 16030
  neuraminidase__InfluenzaA__ABW40282

SEQ ID NO: 16179 - protein, 470 aa, Artificial Sequence; identical to SEQ ID NO: 16065
  neuraminidase__InfluenzaA__ABW40293

SEQ ID NO: 16180 - protein, 470 aa, Artificial Sequence; identical to SEQ ID NO: 16030
  neuraminidase__InfluenzaA__ABW40304

SEQ ID NO: 16181 - protein, 470 aa, Artificial Sequence; identical to SEQ ID NO: 16030
  neuraminidase__InfluenzaA__ABW40315

SEQ ID NO: 16182 - protein, 469 aa, Artificial Sequence; identical to SEQ ID NO: 15884
  neuraminidase__InfluenzaA__ABW40326

SEQ ID NO: 16183 - protein, 470 aa, Artificial Sequence; identical to SEQ ID NO: 16071
  neuraminidase__InfluenzaA__ABW40337

SEQ ID NO: 16184 - protein, 470 aa, Artificial Sequence; identical to SEQ ID NO: 16065
  neuraminidase__InfluenzaA__ABW40359

SEQ ID NO: 16185 - protein, 470 aa, Artificial Sequence
  neuraminidase__InfluenzaA__ABW40370
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDSGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16186 - protein, 470 aa, Artificial Sequence; identical to SEQ ID NO: 16030
  neuraminidase__InfluenzaA__ABW40403

SEQ ID NO: 16187 - protein, 470 aa, Artificial Sequence
  neuraminidase__InfluenzaA__ABW40414
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFDQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16188 - protein, 470 aa, Artificial Sequence; identical to SEQ ID NO: 16030
  neuraminidase__InfluenzaA__ABW40425

SEQ ID NO: 16189 - protein, 470 aa, Artificial Sequence; identical to SEQ ID NO: 16071
  neuraminidase__InfluenzaA__ABW40436

SEQ ID NO: 16190 - protein, 470 aa, Artificial Sequence
  neuraminidase__InfluenzaA__ABW40447
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLNCIRPCFWVELVRGLPRENTTIWTSGSSISFCGVDSDTANWSWPDGAELPFTIDK

SEQ ID NO: 16191 - protein, 470 aa, Artificial Sequence; identical to SEQ ID NO: 16056
  neuraminidase__InfluenzaA__ABW40458

SEQ ID NO: 16192 - protein, 470 aa, Artificial Sequence; identical to SEQ ID NO: 16030
  neuraminidase__InfluenzaA__ABW40469

SEQ ID NO: 16193 - protein, 470 aa, Artificial Sequence; identical to SEQ ID NO: 16030
  neuraminidase__InfluenzaA__ABW40491

SEQ ID NO: 16194 - protein, 470 aa, Artificial Sequence; identical to SEQ ID NO: 16030
  neuraminidase__InfluenzaA__ABW40502

SEQ ID NO: 16195 - protein, 470 aa, Artificial Sequence; identical to SEQ ID NO: 16071
  neuraminidase__InfluenzaA__ABW40513

SEQ ID NO: 16196 - protein, 470 aa, Artificial Sequence; identical to SEQ ID NO: 16030
  neuraminidase__InfluenzaA__ABW40524

SEQ ID NO: 16197 - protein, 470 aa, Artificial Sequence
  neuraminidase__InfluenzaA__ABW40546
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16198 - protein, 470 aa, Artificial Sequence; identical to SEQ ID NO: 16030
  neuraminidase__InfluenzaA__ABW40557

SEQ ID NO: 16199 - protein, 470 aa, Artificial Sequence
  neuraminidase__InfluenzaA__ABW40568
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16200 - protein, 470 aa, Artificial Sequence
  neuraminidase__InfluenzaA__ABW40579
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPNNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16201 - protein, 470 aa, Artificial Sequence
  neuraminidase__InfluenzaA__ABW40601
MNPNQKIITIGSISIAIGVISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGIKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVDGDTANWSWPDGAELPFTIDK

SEQ ID NO: 16202 - protein, 470 aa, Artificial Sequence; identical to SEQ ID NO: 16065
  neuraminidase__InfluenzaA__ABW40612

SEQ ID NO: 16203 - protein, 470 aa, Artificial Sequence; identical to SEQ ID NO: 16030
  neuraminidase__InfluenzaA__ABW40623

SEQ ID NO: 16204 - protein, 469 aa, Artificial Sequence; identical to SEQ ID NO: 15884
  neuraminidase__InfluenzaA__ABW40634

SEQ ID NO: 16205 - protein, 470 aa, Artificial Sequence; identical to SEQ ID NO: 16030
  neuraminidase__InfluenzaA__ABW40645

SEQ ID NO: 16206 - protein, 469 aa, Artificial Sequence
  neuraminidase__InfluenzaA__ABW40656
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGGIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16207 - protein, 470 aa, Artificial Sequence; identical to SEQ ID NO: 16071
  neuraminidase__InfluenzaA__ABW40667

SEQ ID NO: 16208 - protein, 470 aa, Artificial Sequence; identical to SEQ ID NO: 16056
  neuraminidase__InfluenzaA__ABW40678

SEQ ID NO: 16209 - protein, 470 aa, Artificial Sequence; identical to SEQ ID NO: 16065
  neuraminidase__InfluenzaA__ABW71297

SEQ ID NO: 16210 - protein, 470 aa, Artificial Sequence; identical to SEQ ID NO: 16071
  neuraminidase__InfluenzaA__ABW71308

SEQ ID NO: 16211 - protein, 470 aa, Artificial Sequence; identical to SEQ ID NO: 16030
  neuraminidase__InfluenzaA__ABW71319

SEQ ID NO: 16212 - protein, 470 aa, Artificial Sequence; identical to SEQ ID NO: 16030
  neuraminidase__InfluenzaA__ABW71330

SEQ ID NO: 16213 - protein, 470 aa, Artificial Sequence
  neuraminidase__InfluenzaA__ABW71341
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWLGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16214 - protein, 469 aa, Artificial Sequence; identical to SEQ ID NO: 16057
  neuraminidase__InfluenzaA__ABW71352

SEQ ID NO: 16215 - protein, 470 aa, Artificial Sequence; identical to SEQ ID NO: 16071
  neuraminidase__InfluenzaA__ABW71363

SEQ ID NO: 16216 - protein, 470 aa, Artificial Sequence; identical to SEQ ID NO: 16056
  neuraminidase__InfluenzaA__ABW71374

SEQ ID NO: 16217 - protein, 470 aa, Artificial Sequence; identical to SEQ ID NO: 16030
  neuraminidase__InfluenzaA__ABW71385

SEQ ID NO: 16218 - protein, 470 aa, Artificial Sequence
  neuraminidase__InfluenzaA__ABW71396
MNPNQKIITIGSISIAIGIISLMLQIGNIISIWASHSVQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENATIWTSGSSISFCGVDSDTANWSWPDGAELPFTIDK

SEQ ID NO: 16219 - protein, 470 aa, Artificial Sequence
  neuraminidase__InfluenzaA__ABW71407
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKIRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16220 - protein, 470 aa, Artificial Sequence; identical to SEQ ID NO: 16056
  neuraminidase__InfluenzaA__ABW71418

SEQ ID NO: 16221 - protein, 470 aa, Artificial Sequence; identical to SEQ ID NO: 16030
  neuraminidase__InfluenzaA__ABW71440

SEQ ID NO: 16222 - protein, 470 aa, Artificial Sequence; identical to SEQ ID NO: 16030
  neuraminidase__InfluenzaA__ABW71451

SEQ ID NO: 16223 - protein, 470 aa, Artificial Sequence; identical to SEQ ID NO: 16065
  neuraminidase__InfluenzaA__ABW71462

SEQ ID NO: 16224 - protein, 469 aa, Artificial Sequence; identical to SEQ ID NO: 14327
  neuraminidase__InfluenzaA__ABW80980

SEQ ID NO: 16225 - protein, 469 aa, Artificial Sequence; identical to SEQ ID NO: 14171
  neuraminidase__InfluenzaA__ABW80981

SEQ ID NO: 16226 - protein, 470 aa, Artificial Sequence
  neuraminidase__InfluenzaA__ABW81474
MNPNQKIITIGSISVAIGIISLILQIGNIISIWASHSIQTGSQNYTGICNQKIITYENRTWVNQTYVNFNNTNVVAGKDKPSMTLAGNSSLCPIRGWAIYTKDNSIRIGSKGDVFVIREPFISCSHLECRTFFLTQGALLNDKHSNGTIKDRSPFRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 16227 - protein, 470 aa, Artificial Sequence
  neuraminidase__InfluenzaA__ABW81475
MNPNQKIITIGSISIAIGIISLMLQIGNIISIWASHSIQTGSQNHTGICNQRIITYENSTWVNHTYVNINNTNVVAGKDKSSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSLKQDVVAITDWSGYSGSFVQHPELTGLDCIRPCFWVELVRGLPRENTTIWTSGSSISFCGVNSDTANWSWPDGAELPFTIDK

SEQ ID NO: 16228 - protein, 470 aa, Artificial Sequence
  neuraminidase__InfluenzaA__ABW81477
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELSAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWPDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 16229 - protein, 470 aa, Artificial Sequence
  neuraminidase__InfluenzaA__ABW81478
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKNNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16230 - protein, 470 aa, Artificial Sequence
  neuraminidase__InfluenzaA__ABW81479
MNPNQKIITIGSISVAIGIISLILQIGNIISIWASHSIQTGSQNYTGICNQKIITYENRTWVNQTYVNINNTNVVAGKDKPSMTLAGNSSLCPIRGWAIYTKDNSIRIGSKGDVFVIREPFISCSHLECRTFFLTQGALLNDKHSNGTIKDRSPFRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGIKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 16231 - protein, 470 aa, Artificial Sequence; identical to SEQ ID NO: 14396
  neuraminidase__InfluenzaA__ABW81480

SEQ ID NO: 16232 - protein, 470 aa, Artificial Sequence
  neuraminidase__InfluenzaA__ABW81481
MNPNQKIITIGSISVAIGIISLILQIGNIISIWASHSIQTGSQNYTGICNQKIITYENRTWVNQTYVNINNTNVVAGKDKPSMTLAGNSSLCPIRGWAIYTKDNSIRIGSKGDVFVIREPFISCSHLECRTFFLTQGALLNDKHSNGTIKDRSPFRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 16233 - protein, 470 aa, Artificial Sequence
  neuraminidase__InfluenzaA__ABW81482
MNPNQKIITIGSISVAIGIISLILQIGNIISIWASHSIQTGSQNYTGICNQKIITYENRTWVNQTYVNINNTNVVAGKDKPSMTLAGNSSLCPIRGWAIYTKDNSIRIGSKGDVFVIREPFISCSHLECRTFFLTQGALLNDKHSNGTIKDRSPFRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLACMRPCFWVELVRGLPRENTTIWTSGSSISFCGVNSETANWSWPDGAELPFTIDK

SEQ ID NO: 16234 - protein, 470 aa, Artificial Sequence; identical to SEQ ID NO: 14386
  neuraminidase__InfluenzaA__ABW81483

SEQ ID NO: 16235 - protein, 470 aa, Artificial Sequence
  neuraminidase__InfluenzaA__ABW81484
MNPNQKIITIGSISIAIGIISLMLQIGNIISIWASHSIQTGNQNHTGICNQRIITYENSTWVNHTYVNINNTNVVAGKGKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16236 - protein, 470 aa, Artificial Sequence
  neuraminidase__InfluenzaA__ABW81487
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFIQHPELTGLDCIRPCFWVELVRGLPRENTTIWTSGSSISFCGVDSDTANWSWPDGAELPFTIDK

SEQ ID NO: 16237 - protein, 470 aa, Artificial Sequence; identical to SEQ ID NO: 14386
  neuraminidase__InfluenzaA__ABW81488

SEQ ID NO: 16238 - protein, 470 aa, Artificial Sequence; identical to SEQ ID NO: 14386
  neuraminidase__InfluenzaA__ABW81489

SEQ ID NO: 16239 - protein, 470 aa, Artificial Sequence
  neuraminidase__InfluenzaA__ABW81490
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16240 - protein, 470 aa, Artificial Sequence
  neuraminidase__InfluenzaA__ABW81491
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWEKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16241 - protein, 470 aa, Artificial Sequence
  neuraminidase__InfluenzaA__ABW81492
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWASGSSISFCGVDSDTANWSWPDGAELPFTIDK

SEQ ID NO: 16242 - protein, 470 aa, Artificial Sequence; identical to SEQ ID NO: 14386
  neuraminidase__InfluenzaA__ABW81493

SEQ ID NO: 16243 - protein, 470 aa, Artificial Sequence; identical to SEQ ID NO: 14386
  neuraminidase__InfluenzaA__ABW81494

SEQ ID NO: 16244 - protein, 470 aa, Artificial Sequence; identical to SEQ ID NO: 14386
  neuraminidase__InfluenzaA__ABW81495

SEQ ID NO: 16245 - protein, 470 aa, Artificial Sequence; identical to SEQ ID NO: 16240
  neuraminidase__InfluenzaA__ABW81497

SEQ ID NO: 16246 - protein, 470 aa, Artificial Sequence
  neuraminidase__InfluenzaA__ABW81498
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWEKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16247 - protein, 470 aa, Artificial Sequence
  neuraminidase__InfluenzaA__ABW81499
MNPNQKIITIGSISIAIGIISLMLQIGNIISIWASHSIQTGSQNHTGICNQRIITYENSTWVNHTYVNINNTNVVAGRDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16248 - protein, 470 aa, Artificial Sequence
  neuraminidase__InfluenzaA__ABW81500
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTADGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16249 - protein, 470 aa, Artificial Sequence
  neuraminidase__InfluenzaA__ABW81501
MNPNQKIITIGSISIAIGIISLMLQIGNIISIWASHSIQTGSQNHTGICNQKIITYENSTWVNHTYVNINNTNVVAGKDKTSVTLAGNSSLCSVSGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16250 - protein, 470 aa, Artificial Sequence; identical to SEQ ID NO: 16071
  neuraminidase__InfluenzaA__ABW86324

SEQ ID NO: 16251 - protein, 470 aa, Artificial Sequence; identical to SEQ ID NO: 16043
  neuraminidase__InfluenzaA__ABW86335

SEQ ID NO: 16252 - protein, 470 aa, Artificial Sequence; identical to SEQ ID NO: 16030
  neuraminidase__InfluenzaA__ABW86346

SEQ ID NO: 16253 - protein, 470 aa, Artificial Sequence; identical to SEQ ID NO: 16030
  neuraminidase__InfluenzaA__ABW86357

SEQ ID NO: 16254 - protein, 470 aa, Artificial Sequence; identical to SEQ ID NO: 16030
  neuraminidase__InfluenzaA__ABW86368

SEQ ID NO: 16255 - protein, 470 aa, Artificial Sequence; identical to SEQ ID NO: 16056
  neuraminidase__InfluenzaA__ABW86379

SEQ ID NO: 16256 - protein, 470 aa, Artificial Sequence; identical to SEQ ID NO: 16030
  neuraminidase__InfluenzaA__ABW86390

SEQ ID NO: 16257 - protein, 470 aa, Artificial Sequence; identical to SEQ ID NO: 16071
  neuraminidase__InfluenzaA__ABW86401

SEQ ID NO: 16258 - protein, 470 aa, Artificial Sequence; identical to SEQ ID NO: 16030
  neuraminidase__InfluenzaA__ABW86412

SEQ ID NO: 16259 - protein, 470 aa, Artificial Sequence
  neuraminidase__InfluenzaA__ABW86423
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFAIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16260 - protein, 470 aa, Artificial Sequence; identical to SEQ ID NO: 16030
  neuraminidase__InfluenzaA__ABW86434

SEQ ID NO: 16261 - protein, 470 aa, Artificial Sequence; identical to SEQ ID NO: 16030
  neuraminidase__InfluenzaA__ABW86445

SEQ ID NO: 16262 - protein, 470 aa, Artificial Sequence; identical to SEQ ID NO: 16065
  neuraminidase__InfluenzaA__ABW86456

SEQ ID NO: 16263 - protein, 470 aa, Artificial Sequence
  neuraminidase__InfluenzaA__ABW86467
MNTNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSIKQDVVAITDWSGYSGSFVQHPELTGLDCIRPCFWVELVRGLPRENTTIWTSGSSISFCGVDSDTANWSWPDGAELPFTIDK

SEQ ID NO: 16264 - protein, 470 aa, Artificial Sequence; identical to SEQ ID NO: 16065
  neuraminidase__InfluenzaA__ABW86478

SEQ ID NO: 16265 - protein, 470 aa, Artificial Sequence
  neuraminidase__InfluenzaA__ABW86489
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVGITDWSGYSGSFVQHPELTGLDCIRPCFWVELVRGLPRENTTIWTSGSSISFCGVDSDTANWSWPDGAELPFTIDK

SEQ ID NO: 16266 - protein, 470 aa, Artificial Sequence
  neuraminidase__InfluenzaA__ABW86500
MNPNQKIMTIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTNTDSDFSMKQDVVAITDWSGYSGSFVQHPELTGLDCIRPCFWVELVRGLPRENTTIWTSGSSISFCGVDSDTANWSWPDGAELPFTIDK

SEQ ID NO: 16267 - protein, 470 aa, Artificial Sequence; identical to SEQ ID NO: 16030
  neuraminidase__InfluenzaA__ABW86511

SEQ ID NO: 16268 - protein, 470 aa, Artificial Sequence
  neuraminidase__InfluenzaA__ABW86522
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAVTDWSGYSGSFVQHPELTGLDCIRPCFWVELVRGLPRENATIWTSGSSISFCGVDSDTANWSWPDGAELPFTIDK

SEQ ID NO: 16269 - protein, 470 aa, Artificial Sequence; identical to SEQ ID NO: 16030
  neuraminidase__InfluenzaA__ABW86533

SEQ ID NO: 16270 - protein, 470 aa, Artificial Sequence; identical to SEQ ID NO: 16065
  neuraminidase__InfluenzaA__ABW86544

SEQ ID NO: 16271 - protein, 470 aa, Artificial Sequence; identical to SEQ ID NO: 16030
  neuraminidase__InfluenzaA__ABW86555

SEQ ID NO: 16272 - protein, 469 aa, Artificial Sequence
  neuraminidase__InfluenzaA__ABW86566
MNPNQKIITIGSVSLTISTICFFMQTAILITTVTLHFKQYEFNSPPNNQVMLCEPTVIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16273 - protein, 470 aa, Artificial Sequence; identical to SEQ ID NO: 16056
  neuraminidase__InfluenzaA__ABW86609

SEQ ID NO: 16274 - protein, 470 aa, Artificial Sequence; identical to SEQ ID NO: 15059
  neuraminidase__InfluenzaA__ABW91188

SEQ ID NO: 16275 - protein, 469 aa, Artificial Sequence
  neuraminidase__InfluenzaA__ABW91210
MNPNQKIITIGSVSLTISTICFFMQIAILITTVTLHFKQYEFNSPPNNQVILCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16276 - protein, 470 aa, Artificial Sequence; identical to SEQ ID NO: 16030
  neuraminidase__InfluenzaA__ABW91221

SEQ ID NO: 16277 - protein, 469 aa, Artificial Sequence
  neuraminidase__InfluenzaA__ABW91232
MNPNQKIITIGSVSLTISTICFFMQIAILITTVTLHFKQYEFNSPPNNQVMLCESTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16278 - protein, 469 aa, Artificial Sequence; identical to SEQ ID NO: 16066
  neuraminidase__InfluenzaA__ABW91243

SEQ ID NO: 16279 - protein, 469 aa, Artificial Sequence; identical to SEQ ID NO: 15884
  neuraminidase__InfluenzaA__ABW91254

SEQ ID NO: 16280 - protein, 469 aa, Artificial Sequence; identical to SEQ ID NO: 15884
  neuraminidase__InfluenzaA__ABW91265

SEQ ID NO: 16281 - protein, 470 aa, Artificial Sequence; identical to SEQ ID NO: 16030
  neuraminidase__InfluenzaA__ABW91276

SEQ ID NO: 16282 - protein, 470 aa, Artificial Sequence
  neuraminidase__InfluenzaA__ABW91287
MNPNQKIITIGSISIAIGIISLILQIGNIISIWASHSIQTGSQNHTGICNQRIITYENSTWVNNTYVNINNTNVVAEKDKTSVTLAGNSSLCSISGWAIYTKDNSIRIGSKGDIFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGAASYKIFKIEKGKVTKTIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDIVAITDWSGYSGSFVQHPELTGLDCIRPCFWVELVRGLPRENTTIWTSGSSISFCGVNSGTANWSWPDGAELPFTIDK

SEQ ID NO: 16283 - protein, 470 aa, Artificial Sequence; identical to SEQ ID NO: 16030
  neuraminidase__InfluenzaA__ABW91298

SEQ ID NO: 16284 - protein, 470 aa, Artificial Sequence
  neuraminidase__InfluenzaA__ABW91309
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSDGAASYKIFKIEKGKVTKSIELNAPNFHYEECSCYPDTGTVMCVCRDNWHGSNRPWVSFNQNLDYQIGYICSGVFGDNPRPKDGKGSCNPVTADGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16285 - protein, 470 aa, Artificial Sequence; identical to SEQ ID NO: 16030
  neuraminidase__InfluenzaA__ABW91320

SEQ ID NO: 16286 - protein, 470 aa, Artificial Sequence; identical to SEQ ID NO: 16030
  neuraminidase__InfluenzaA__ABW91331

SEQ ID NO: 16287 - protein, 470 aa, Artificial Sequence; identical to SEQ ID NO: 16030
  neuraminidase__InfluenzaA__ABW91342

SEQ ID NO: 16288 - protein, 470 aa, Artificial Sequence; identical to SEQ ID NO: 16030
  neuraminidase__InfluenzaA__ABW91353

SEQ ID NO: 16289 - protein, 470 aa, Artificial Sequence
  neuraminidase__InfluenzaA__ABW91364
MNTNQKIITIGSISIAIGIISLMLQIGNIISIWASHSIQTGSQNHTGICNQRIITYENSTWVNHTYVNINNTNVVTGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSDGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNKLRKGFEMIWDPNGWTDTDNDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16290 - protein, 470 aa, Artificial Sequence; identical to SEQ ID NO: 16030
  neuraminidase__InfluenzaA__ABW91375

SEQ ID NO: 16291 - protein, 470 aa, Artificial Sequence; identical to SEQ ID NO: 16056
  neuraminidase__InfluenzaA__ABW91386

SEQ ID NO: 16292 - protein, 469 aa, Artificial Sequence
  neuraminidase__InfluenzaA__ABW91397
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECICINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16293 - protein, 470 aa, Artificial Sequence; identical to SEQ ID NO: 16201
  neuraminidase__InfluenzaA__ABW91408

SEQ ID NO: 16294 - protein, 470 aa, Artificial Sequence
  neuraminidase__InfluenzaA__ABW91419
MNPNQKIITIGSISIAIGIISLMLQIGNIISIWASHSIQTGSQNHTGICNQRIITYENSTWVNHTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16295 - protein, 470 aa, Artificial Sequence
  neuraminidase__InfluenzaA__ABW91430
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGSVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16296 - protein, 469 aa, Artificial Sequence; identical to SEQ ID NO: 15884
  neuraminidase__InfluenzaA__ABW91441

SEQ ID NO: 16297 - protein, 470 aa, Artificial Sequence; identical to SEQ ID NO: 16071
  neuraminidase__InfluenzaA__ABW91452

SEQ ID NO: 16298 - protein, 470 aa, Artificial Sequence; identical to SEQ ID NO: 16071
  neuraminidase__InfluenzaA__ABW91463

SEQ ID NO: 16299 - protein, 470 aa, Artificial Sequence; identical to SEQ ID NO: 16030
  neuraminidase__InfluenzaA__ABW91474

SEQ ID NO: 16300 - protein, 470 aa, Artificial Sequence; identical to SEQ ID NO: 16071
  neuraminidase__InfluenzaA__ABW91485

SEQ ID NO: 16301 - protein, 470 aa, Artificial Sequence; identical to SEQ ID NO: 16030
  neuraminidase__InfluenzaA__ABW91496

SEQ ID NO: 16302 - protein, 470 aa, Artificial Sequence; identical to SEQ ID NO: 16056
  neuraminidase__InfluenzaA__ABW91507

SEQ ID NO: 16303 - protein, 470 aa, Artificial Sequence; identical to SEQ ID NO: 16071
  neuraminidase__InfluenzaA__ABW91518

SEQ ID NO: 16304 - protein, 470 aa, Artificial Sequence
  neuraminidase__InfluenzaA__ABW91529
MNPNQKIITIGSISIAIGTISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTIKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16305 - protein, 470 aa, Artificial Sequence
  neuraminidase__InfluenzaA__ABW91540
MNPNQKIITIGSISIAIGIISLMLQIGNIISIWASHSIQTGSQNHTGICNQRIITYENSTWMNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSVELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16306 - protein, 469 aa, Artificial Sequence
  neuraminidase__InfluenzaA__ABW91551
MNPNQKIITIGSVSLTISTICFFMQIAILITTVTLHFKQYEFNFPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16307 - protein, 470 aa, Artificial Sequence; identical to SEQ ID NO: 16030
  neuraminidase__InfluenzaA__ABW91562

SEQ ID NO: 16308 - protein, 470 aa, Artificial Sequence; identical to SEQ ID NO: 16065
  neuraminidase__InfluenzaA__ABW91584

SEQ ID NO: 16309 - protein, 470 aa, Artificial Sequence; identical to SEQ ID NO: 16030
  neuraminidase__InfluenzaA__ABW91595

SEQ ID NO: 16310 - protein, 470 aa, Artificial Sequence; identical to SEQ ID NO: 16071
  neuraminidase__InfluenzaA__ABW91606

SEQ ID NO: 16311 - protein, 470 aa, Artificial Sequence; identical to SEQ ID NO: 16065
  neuraminidase__InfluenzaA__ABW91617

SEQ ID NO: 16312 - protein, 470 aa, Artificial Sequence; identical to SEQ ID NO: 16030
  neuraminidase__InfluenzaA__ABW91628

SEQ ID NO: 16313 - protein, 470 aa, Artificial Sequence; identical to SEQ ID NO: 16030
  neuraminidase__InfluenzaA__ABW91639

SEQ ID NO: 16314 - protein, 469 aa, Artificial Sequence; identical to SEQ ID NO: 15884
  neuraminidase__InfluenzaA__ABW91650

SEQ ID NO: 16315 - protein, 449 aa, Artificial Sequence
  neuraminidase__InfluenzaA__ABX10517
MNPNKKIITIGSICMVTGMVSLMLQIGNLISIWVSHSIHTGNQHKAEPISNTNFLTEKAVASVKLAGNSSLCPINGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWASGSSISFCGVNSDTVGWSWPDGAELPFTIDK

SEQ ID NO: 16316 - protein, 469 aa, Artificial Sequence; identical to SEQ ID NO: 15929
  neuraminidase__InfluenzaA__ABX10527

SEQ ID NO: 16317 - protein, 470 aa, Artificial Sequence
  neuraminidase__InfluenzaA__ABX58242
MNPNQKIITIGSISIAIGIISLMLQIGNIISIWTSHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16318 - protein, 470 aa, Artificial Sequence; identical to SEQ ID NO: 16129
  neuraminidase__InfluenzaA__ABX58253

SEQ ID NO: 16319 - protein, 470 aa, Artificial Sequence; identical to SEQ ID NO: 16030
  neuraminidase__InfluenzaA__ABX58264

SEQ ID NO: 16320 - protein, 470 aa, Artificial Sequence; identical to SEQ ID NO: 16030
  neuraminidase__InfluenzaA__ABX58275

SEQ ID NO: 16321 - protein, 470 aa, Artificial Sequence; identical to SEQ ID NO: 16030
  neuraminidase__InfluenzaA__ABX58286

SEQ ID NO: 16322 - protein, 470 aa, Artificial Sequence
  neuraminidase__InfluenzaA__ABX58297
MNPNQKIITIGSISIAIGIISLMLQIGNIISIWASHSIQTGSQNHTGICNQKIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16323 - protein, 470 aa, Artificial Sequence; identical to SEQ ID NO: 16201
  neuraminidase__InfluenzaA__ABX58308

SEQ ID NO: 16324 - protein, 470 aa, Artificial Sequence
  neuraminidase__InfluenzaA__ABX58319
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTIKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16325 - protein, 470 aa, Artificial Sequence; identical to SEQ ID NO: 16201
  neuraminidase__InfluenzaA__ABX58352

SEQ ID NO: 16326 - protein, 470 aa, Artificial Sequence; identical to SEQ ID NO: 16030
  neuraminidase__InfluenzaA__ABX58363

SEQ ID NO: 16327 - protein, 470 aa, Artificial Sequence; identical to SEQ ID NO: 16030
  neuraminidase__InfluenzaA__ABX58385

SEQ ID NO: 16328 - protein, 470 aa, Artificial Sequence; identical to SEQ ID NO: 16030
  neuraminidase__InfluenzaA__ABX58396

SEQ ID NO: 16329 - protein, 470 aa, Artificial Sequence
  neuraminidase__InfluenzaA__ABX58407
MNPNQKIITIGSISIAIGIISLMLQIGNIISIWASHSIQTGSQNHTGICNQRIITYENSTWVNHTYVSINNTNVVAGKDKTSVTLAGNSSLCPISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16330 - protein, 470 aa, Artificial Sequence; identical to SEQ ID NO: 16071
  neuraminidase__InfluenzaA__ABX58418

SEQ ID NO: 16331 - protein, 470 aa, Artificial Sequence; identical to SEQ ID NO: 16030
  neuraminidase__InfluenzaA__ABX58429

SEQ ID NO: 16332 - protein, 470 aa, Artificial Sequence; identical to SEQ ID NO: 16030
  neuraminidase__InfluenzaA__ABX58440

SEQ ID NO: 16333 - protein, 470 aa, Artificial Sequence
  neuraminidase__InfluenzaA__ABX58451
MNPNQKIITIGSISIAIGTISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16334 - protein, 470 aa, Artificial Sequence; identical to SEQ ID NO: 16071
  neuraminidase__InfluenzaA__ABX58462

SEQ ID NO: 16335 - protein, 470 aa, Artificial Sequence; identical to SEQ ID NO: 16030
  neuraminidase__InfluenzaA__ABX58473

SEQ ID NO: 16336 - protein, 470 aa, Artificial Sequence; identical to SEQ ID NO: 16071
  neuraminidase__InfluenzaA__ABX58484

SEQ ID NO: 16337 - protein, 470 aa, Artificial Sequence
  neuraminidase__InfluenzaA__ABX58495
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNRTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16338 - protein, 470 aa, Artificial Sequence; identical to SEQ ID NO: 16065
  neuraminidase__InfluenzaA__ABX58506

SEQ ID NO: 16339 - protein, 470 aa, Artificial Sequence; identical to SEQ ID NO: 16071
  neuraminidase__InfluenzaA__ABX58528

SEQ ID NO: 16340 - protein, 470 aa, Artificial Sequence; identical to SEQ ID NO: 16071
  neuraminidase__InfluenzaA__ABX58539

SEQ ID NO: 16341 - protein, 470 aa, Artificial Sequence
  neuraminidase__InfluenzaA__ABX58550
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTVDK

SEQ ID NO: 16342 - protein, 470 aa, Artificial Sequence; identical to SEQ ID NO: 16030
  neuraminidase__InfluenzaA__ABX58561

SEQ ID NO: 16343 - protein, 470 aa, Artificial Sequence
  neuraminidase__InfluenzaA__ABX58572
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPMTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16344 - protein, 470 aa, Artificial Sequence; identical to SEQ ID NO: 16030
  neuraminidase__InfluenzaA__ABX58583

SEQ ID NO: 16345 - protein, 470 aa, Artificial Sequence; identical to SEQ ID NO: 16030
  neuraminidase__InfluenzaA__ABX58594

SEQ ID NO: 16346 - protein, 470 aa, Artificial Sequence; identical to SEQ ID NO: 16056
  neuraminidase__InfluenzaA__ABX58605

SEQ ID NO: 16347 - protein, 470 aa, Artificial Sequence; identical to SEQ ID NO: 16056
  neuraminidase__InfluenzaA__ABX58616

SEQ ID NO: 16348 - protein, 470 aa, Artificial Sequence; identical to SEQ ID NO: 16030
  neuraminidase__InfluenzaA__ABX58627

SEQ ID NO: 16349 - protein, 470 aa, Artificial Sequence; identical to SEQ ID NO: 16030
  neuraminidase__InfluenzaA__ABX58638

SEQ ID NO: 16350 - protein, 470 aa, Artificial Sequence
  neuraminidase__InfluenzaA__ABX58682
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTMMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16351 - protein, 470 aa, Artificial Sequence
  neuraminidase__InfluenzaA__ABX58693
MNPNQKIITIGSISIAIGIISLMLQIGNIISIWASHSIQTGSQNNTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNRAASYKIFKIEKGKVTKSIELNAPNFHYEECSCYPDTGIVMCVCRDNWHGSNRPWVSFNQNLDYQIGYICSGVLGDNPRPEDGEGSCNPVTVDGADGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16352 - protein, 470 aa, Artificial Sequence; identical to SEQ ID NO: 16201
  neuraminidase__InfluenzaA__ABX58704

SEQ ID NO: 16353 - protein, 470 aa, Artificial Sequence; identical to SEQ ID NO: 16129
  neuraminidase__InfluenzaA__ABX58715

SEQ ID NO: 16354 - protein, 449 aa, Artificial Sequence
  neuraminidase__InfluenzaA__ABY19420
MNPNQKVITIGSICMVIGIVSLMLQIGNMISIWVSHSIQTGNQNQVEPIINTNFLTGKAVASITLAGNSSLCPIRGWAIHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVIKSVELDAPNYHYEECSCYPDAGEITCVCRDNWHGSNRPWVSFNQNLEYQIGYICSGVFGDNPRPNDGTGSCGPVSHNGAYGVKGFSFKYGNGVWIGRTKSPNSRSGFEMIWDPNGWSETDSSFSVKQDIVAITDWSGYSGSFVQHPELTGLDCIRPCFWVELIRGRPKESTVWTSGSSISFCGVNSDTVSWSWPDGAELPFSIDK

SEQ ID NO: 16355 - protein, 449 aa, Artificial Sequence
  neuraminidase__InfluenzaA__ABY19421
MNPNQKIITIGSICMVIGIVSLMLQIGNMISIWVSHSIQTGNQNQVEPIINTNFLTGKAVASITLAGNSSLCPIRGWAIHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVIKSVELDAPNYHYEECSCYPDAGEITCVCRDNWHGSNRPWVSFNQNLEYQIGYICSGVFGDNPRPNDGTGSCGPVSHNGAYGVKGFSFKYGNGVWIGRTKSPNSRSGFEMIWDPNGWSETDSSFSVKQDIVAITDWSGYSGSFVQHPELTGLDCIRPCFWVELIRGRPKESTVWTSGSSISFCGVNSDTVSWSWPDGAELPFSIDK

SEQ ID NO: 16356 - protein, 470 aa, Artificial Sequence
  neuraminidase__InfluenzaA__ABY51020
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPLTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16357 - protein, 469 aa, Artificial Sequence; identical to SEQ ID NO: 16066
  neuraminidase__InfluenzaA__ABY51031

SEQ ID NO: 16358 - protein, 470 aa, Artificial Sequence
  neuraminidase__InfluenzaA__ABY51042
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNRAASYKIFKIEKGKVTKSIELNAPNFHYEECSCYPDTGIVMCVCRDNWHGSNRPWVSFNQNLDYQIGYICSGVFGDNPRPKDGEGSCNPVTVDGADGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16359 - protein, 470 aa, Artificial Sequence
  neuraminidase__InfluenzaA__ABY51053
MNPNQKIITIGSISIAIGIISLMLQIGNIISIWASHSIQTGSQNNTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNRAASYKIFKIEKGKVTKSIELNAPNFHYEECSCYPDTGIVMCVCRDNWHGSNRPWVSFNQNLDYQIGYICSGVFGDNPRPEDGEGSCNPVTVDGTDGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16360 - protein, 470 aa, Artificial Sequence; identical to SEQ ID NO: 16129
  neuraminidase__InfluenzaA__ABY51064

SEQ ID NO: 16361 - protein, 470 aa, Artificial Sequence; identical to SEQ ID NO: 16030
  neuraminidase__InfluenzaA__ABY51075

SEQ ID NO: 16362 - protein, 470 aa, Artificial Sequence
  neuraminidase__InfluenzaA__ABY51086
MNPNQKIITIGSISIAIGIISIMLQIGNIISIWASHSIQTGSQNHTGICNQRIITYENSTWVNHTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGIKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVDGDTANWSWPDGAELPFTIDK

SEQ ID NO: 16363 - protein, 470 aa, Artificial Sequence
  neuraminidase__InfluenzaA__ABY51097
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSVELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16364 - protein, 470 aa, Artificial Sequence
  neuraminidase__InfluenzaA__ABY51108
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDIVAITDWSGYSGSFVQHPELTGLDCIRPCFWVELVRGLPRENTTIWTSGSSISFCGVDSDTANWSWPDGAELPFTIDK

SEQ ID NO: 16365 - protein, 470 aa, Artificial Sequence; identical to SEQ ID NO: 16030
  neuraminidase__InfluenzaA__ABY51119

SEQ ID NO: 16366 - protein, 469 aa, Artificial Sequence; identical to SEQ ID NO: 15884
  neuraminidase__InfluenzaA__ABY51130

SEQ ID NO: 16367 - protein, 470 aa, Artificial Sequence; identical to SEQ ID NO: 16071
  neuraminidase__InfluenzaA__ABY51141

SEQ ID NO: 16368 - protein, 470 aa, Artificial Sequence
  neuraminidase__InfluenzaA__ABY51152
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16369 - protein, 470 aa, Artificial Sequence
  neuraminidase__InfluenzaA__ABY51163
MNPNQKIITIGSISIAIGIISLMLQIGNIISIWASHSIQTGSQNHTGICNQRIITYENSTWVNHTYVNINNTNVVAGKDKTSVILAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16370 - protein, 470 aa, Artificial Sequence
  neuraminidase__InfluenzaA__ABY51174
MNPNQKMITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQVGYICSGVFGDNPRPKDGKGSCNPMTVDGADGVKGFSYKYGNGVWIGRTKSNKLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16371 - protein, 470 aa, Artificial Sequence; identical to SEQ ID NO: 16030
  neuraminidase__InfluenzaA__ABY51185

SEQ ID NO: 16372 - protein, 470 aa, Artificial Sequence; identical to SEQ ID NO: 16065
  neuraminidase__InfluenzaA__ABY51196

SEQ ID NO: 16373 - protein, 469 aa, Artificial Sequence; identical to SEQ ID NO: 16066
  neuraminidase__InfluenzaA__ABY51229

SEQ ID NO: 16374 - protein, 470 aa, Artificial Sequence
  neuraminidase__InfluenzaA__ABY51240
MNPNQKIITIGSISIAIGIISLMLQIGNIISVWASHSIQTGSQNHTGICNQRIITYENSTWVNHTYVSINNTNVVAGKDKTSVTLAGNSSLCSISGWSIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16375 - protein, 470 aa, Artificial Sequence; identical to SEQ ID NO: 16056
  neuraminidase__InfluenzaA__ABY51251

SEQ ID NO: 16376 - protein, 470 aa, Artificial Sequence
  neuraminidase__InfluenzaA__ABY51262
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENATIWTSGSSISFCGVDSDTANWSWPDGAELPFTIDK

SEQ ID NO: 16377 - protein, 469 aa, Artificial Sequence; identical to SEQ ID NO: 15884
  neuraminidase__InfluenzaA__ABY51273

SEQ ID NO: 16378 - protein, 449 aa, Artificial Sequence
  neuraminidase__InfluenzaA__ABY76285
MNPNQKIITIGSICMVIGIVSLMLQIGNMISIWVSHSIQTGNQRQAEPISNTKFLTEKAVASVTLAGNSSLCPISGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 16379 - protein, 470 aa, Artificial Sequence
  neuraminidase__InfluenzaA__ABY81352
MNPNQKIITIGSICMAIGIISLILQIGSIISIWVSHSIQTGSQNHTGICNQRIITYENSTWVNQTYVNISNTNVVAGKDTTSMTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKQILRTQESECVCVNGSCFTIMTDGPSDGQASYRIFKIEKGKITKSIELDAPNSHYEECSCYPDTGTVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 16380 - protein, 470 aa, Artificial Sequence
  neuraminidase__InfluenzaA__ABY81363
MNPNQKIITIGSISIAIGIISLMLQIGNIISIWASHSIQIGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16381 - protein, 469 aa, Artificial Sequence; identical to SEQ ID NO: 16066
  neuraminidase__InfluenzaA__ABY81374

SEQ ID NO: 16382 - protein, 470 aa, Artificial Sequence; identical to SEQ ID NO: 16030
  neuraminidase__InfluenzaA__ABY81385

SEQ ID NO: 16383 - protein, 470 aa, Artificial Sequence
  neuraminidase__InfluenzaA__ABY81407
MNPNQKIITIGSISIAIGTISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFLVKQDVVAITDWSGYSGSFVQHPELTGLDCIRPCFWVELVRGLPRENTTIWTSGSSISFCGVDSDTANWSWPDGAELPFTIDK

SEQ ID NO: 16384 - protein, 469 aa, Artificial Sequence; identical to SEQ ID NO: 16066
  neuraminidase__InfluenzaA__ACA24505

SEQ ID NO: 16385 - protein, 470 aa, Artificial Sequence; identical to SEQ ID NO: 16030
  neuraminidase__InfluenzaA__ACA24516

SEQ ID NO: 16386 - protein, 470 aa, Artificial Sequence; identical to SEQ ID NO: 16030
  neuraminidase__InfluenzaA__ACA24527

SEQ ID NO: 16387 - protein, 469 aa, Artificial Sequence
  neuraminidase__InfluenzaA__ACA24692
MNPNQKIITIGSVSLTISTICFFMQIAILITTVTLHFKQYEFSPPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSKYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRNEETEVLWTSNSIVVFCGTSGTYGTGSWPDGADINLMPI

SEQ ID NO: 16388 - protein, 469 aa, Artificial Sequence
  neuraminidase__InfluenzaA__ACA24703
MNPNQKIITIGSVSLTISTICFFMQIAILITTVTLHFKQYEFSSPPNNQVMLCEPTIIERNITEIVYLTNITIEKETCPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGNADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16389 - protein, 470 aa, Artificial Sequence
  neuraminidase__InfluenzaA__ACA33539
MNPYQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFYYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16390 - protein, 470 aa, Artificial Sequence
  neuraminidase__InfluenzaA__ACA33540
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFYYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16391 - protein, 470 aa, Artificial Sequence
  neuraminidase__InfluenzaA__ACA33582
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFYYEECSCYPDTGTVMCVCRDNWHGSNRPWVSFNQNLDYQIGYICSGVFGDNPRPKDGKGSCNPMTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16392 - protein, 470 aa, Artificial Sequence
  neuraminidase__InfluenzaA__ACA33622
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFYYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16393 - protein, 470 aa, Artificial Sequence; identical to SEQ ID NO: 16069
  neuraminidase__InfluenzaA__ACA96522

SEQ ID NO: 16394 - protein, 453 aa, Artificial Sequence
  neuraminidase__InfluenzaA__ACC55274
MNPNQKIITIGSVSLTIATVCFLMQIAILAMTVTLHFRQNECSISANSQVVPCEPTTEKEVCSKVVDYRSWSKPQCQITGFAPFSKDNSIRLSAGGDIWITREPYVSCDTSKCYQFALGQGTTLDNEHSNGTIHDRIPHRTLLMNELGVPFHLGTRQVCIAWSSSSCHDGKAWLHVCVTGDDRNATASFIYNGMLVDSIGSWSQNILRTQESECVCINGSCTVVMTDGSASGKADTRILFVKEGKIVHISPLSGSAQHIEECSCYPRYPNVRCVCRDNWKGSNRPVIDINMTDYSIDSSYVCSGLVGDTPRNEDSSSSSNCRDPNEERGNPGVKGWAFDSGDDVWMGRTISRDSRSGYETFRVIGGWTTANSKSQTNRQVIVDNNNWSGYSGIFSVEHKSCINRCFYVELIRGRPKETRVWWTSNSIVVFCGTSGTYGTGSWPDGANINFMPI

SEQ ID NO: 16395 - protein, 470 aa, Artificial Sequence; identical to SEQ ID NO: 16329
  neuraminidase__InfluenzaA__ACC61967

SEQ ID NO: 16396 - protein, 470 aa, Artificial Sequence
  neuraminidase__InfluenzaA__ACD11077
MNPNQKIITIGSICMAIGIISLILQIGNIISIWVSHSIQTGSQNHTGICNQRIITYENSTWVNQTYVNISNTNVVAGKVTTSMTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKQILRTQESECVCVNGSCFTIMTDGPSDGPASYRIFKIEKGKITKSIELDAPNSHYEECSCYPDTGTVMCVCRDNWHGSNRPWVSFNQNLDYQIGYICSGVFGDNPRPKDGKGSCDPVNVDGADGVKGFSYRYGNGVWIGRTKSNNSRKGFEMIWDPNGWTDTDSNFLVKQDVVAMTDWSGYSGSFVQHPELTGLDCMRPCFWVELIRGRPREKTTIWTSGSSISFCGVNSDTVNWSWPDGAELPLTIDK

SEQ ID NO: 16397 - protein, 470 aa, Artificial Sequence
  neuraminidase__InfluenzaA__ACD11078
MNPNQKIITIGSICMAIGIISLILQIGNIISIWVSHSIQTGSQNHTGICNQRIITYENSTWVNQTYVNISNTNVVAGKDTTSMTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKQILRTQESECVCVNGSCFTIMTDGPSDGPASYRIFKIEKGKITKSIELDAPNSHYEECSCYPDTGTVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTVNWSWPDGAELPLTIDK

SEQ ID NO: 16398 - protein, 470 aa, Artificial Sequence
  neuraminidase__InfluenzaA__ACD11079
MNPNQKIITIGSICMAIGIISLILQIGNIISIWVSHSIQTGSQNHTGICNQRIITYENSTWVNQTYVNISNTNVVAGKDTTSMTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVIKYNGIITETIKSWRKQILRTQESECVCVNGSCFTIMTDGPSDGPASYRIFKIEKGKITKSIELDAPNSHYEECSCYPDTGTVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTVNWSWPDGAELPLTIDK

SEQ ID NO: 16399 - protein, 470 aa, Artificial Sequence; identical to SEQ ID NO: 16030
  neuraminidase__InfluenzaA__ACD56116

SEQ ID NO: 16400 - protein, 470 aa, Artificial Sequence; identical to SEQ ID NO: 16030
  neuraminidase__InfluenzaA__ACD56127

SEQ ID NO: 16401 - protein, 469 aa, Artificial Sequence; identical to SEQ ID NO: 15884
  neuraminidase__InfluenzaA__ACD56261

SEQ ID NO: 16402 - protein, 469 aa, Artificial Sequence
  neuraminidase__InfluenzaA__ACD56272
MNPNQKIITIGSVSLTISTICFFMQIAILITTVTLHFKQYEFSSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16403 - protein, 470 aa, Artificial Sequence
  neuraminidase__InfluenzaA__ACD56283
MNPNQKIITIGSISMAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16404 - protein, 469 aa, Artificial Sequence
  neuraminidase__InfluenzaA__ACD56305
MNPNQKIITIGSVSLTIATVCFLMQIAILVTTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCVAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRDPNNERGNPGVKGWAFDNGDDVWMGRTISKDLRSGYETFKVIGGWSTPNSKSQINRQVIVDSNNWSGYSGIFSVEGKSCINRCFYVELIRGRQQETRVWWTSNSIVVFCGTSGTYGTGSWPDGANINFMPI

SEQ ID NO: 16405 - protein, 469 aa, Artificial Sequence
  neuraminidase__InfluenzaA__ACD56316
MNPNQKIITIGSVSLTIATVCFLMQIAILVTTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCVAWSSSSCHDGKAWLHVCVTGDDKNATASFIYDGRLMDSIGSWSQNILRTQESECVCINGTCTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRNPNNERGNPGVKGWAFDNGDDVWMGRTISKDLRSGYETFKVIGGWSTPNSKSQINRQVIVDSNNWSGYSGIFSVEGKRCINRCFYVELIRGRQQETRVWWTSNSIVVFCGTSGTYGTGSWPDGANINFMPI

SEQ ID NO: 16406 - protein, 469 aa, Artificial Sequence
  neuraminidase__InfluenzaA__ACD56327
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPSKCHQFALGQGTTLENKHSNGTKHDRIPHRTLLMNELGVPFHLGTKQVCVAWSSSSCHDGKAWLHVCVTGDDRNATASFIYGGRLVDSIVSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDSRSGYETFKVIGGWSTPNSKSQVNRQVIVDSNNWSGYSGIFSVEGKSCINRCFYVELIRGRPQETRVWWTSNSIVVFCGTSGTYGTGSWPDGANINFMPI

SEQ ID NO: 16407 - protein, 469 aa, Artificial Sequence
  neuraminidase__InfluenzaA__ACD85190
MNPNQKIITIGSVSLTIATVCFLMQIAILVTTVTLHFKQHECDSPASNQVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPIIDINMEDYSIDSSYVCSGLVGDTPRNDDRSSNSNCRNPNNERGNPGVKGWAFDNGDDVWMGRTISKDLRSGYETFKVIGGWSTPNSKSQINRQVIVDSNNWSGYSGIFSVEGKSCINRCFYVELIRGRQQETRVWWTSNSIVVFCGTSGTYGTGSWPDGANINFMPI

SEQ ID NO: 16408 - protein, 469 aa, Artificial Sequence
  neuraminidase__InfluenzaA__ACD85201
MNPNQKIITIGSVSLTIATVCFLMQIAILVTTVTLHFKQHECDSPASNQVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSISSWSQNILRTQESECVCINGTCTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRNPNNERGNPGVKGWAFDNGDDVWMGRTISKDLRSGYETFKVIGGWSTPNSKSQINRQVIVDSNNWSGYSGIFSVEGKSCINRCFYVELIRGRQQETRVWWTSNSIVVFCGTSGTYGTGSWPDGANINFMPI

SEQ ID NO: 16409 - protein, 469 aa, Artificial Sequence
  neuraminidase__InfluenzaA__ACD85212
MNPNQKIITIGSVSLTIATVCFLMQIAILATTVTLHFKQHECDSPASNQVMPCEPIIIERNIKEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTINKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 16410 - protein, 469 aa, Artificial Sequence
  neuraminidase__InfluenzaA__ACD85223
MNPNQKIITIGSVSLTIATACFLMQIAILVTTVTLHFKQHECDSPASNQVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPIIDINMEDYSIDSSYVCSGLVGDTPRNDDRSSNSNCRNPNNERGNPGVKGWAFDNGDDVWMGRTISKDLRSGYETFKVIGGWSTPNSKSQINRQVIVDSNNWSGYSGIFSVEGKSCINRCFYVELIRGRQQETRVWWTSNSIVVFCGTSGTYGTGSWPDGANINFMPI

SEQ ID NO: 16411 - protein, 469 aa, Artificial Sequence
  neuraminidase__InfluenzaA__ACD85234
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSADGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 16412 - protein, 469 aa, Artificial Sequence
  neuraminidase__InfluenzaA__ACD85245
MNPNQKIITIGSVSLIIATVCFLMQIAILVTTVTLHFKQHECDSPASNQVMPCEPIIIERNITEIVYLNNTTIEKEICPRVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDDRSGYSGIFSVEGKSCINRCFYVELIRGRKQETRVWWTSNSIVVFCGTSGTYGTGSWPDGANINFMPI

SEQ ID NO: 16413 - protein, 469 aa, Artificial Sequence
  neuraminidase__InfluenzaA__ACD85454
MNPNQKIITIGSVSLTISTIGFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16414 - protein, 469 aa, Artificial Sequence
  neuraminidase__InfluenzaA__ACD85465
MNPNQKIITIGSVSLTISTIGFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16415 - protein, 469 aa, Artificial Sequence
  neuraminidase__InfluenzaA__ACD85487
MNPNQKIITIGSVSLIISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16416 - protein, 469 aa, Artificial Sequence
  neuraminidase__InfluenzaA__ACD85498
MNPNQKIITIGSVSLIISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16417 - protein, 469 aa, Artificial Sequence
  neuraminidase__InfluenzaA__ACD85509
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGSRGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16418 - protein, 469 aa, Artificial Sequence
  neuraminidase__InfluenzaA__ACD85520
MNPNQKIITIGSVSLIISTIGFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16419 - protein, 469 aa, Artificial Sequence; identical to SEQ ID NO: 16414
  neuraminidase__InfluenzaA__ACD85553

SEQ ID NO: 16420 - protein, 469 aa, Artificial Sequence
  neuraminidase__InfluenzaA__ACD85564
MNPNQKIITIGSVSLIISTICFFMQTAILITTVTLHFKQYEFNSPPNNQVMLCEPTIIERNITETAHLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16421 - protein, 469 aa, Artificial Sequence
  neuraminidase__InfluenzaA__ACD85575
MNPNQKIITIGSVSLIISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADINLMPI

SEQ ID NO: 16422 - protein, 469 aa, Artificial Sequence
  neuraminidase__InfluenzaA__ACD85586
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGRGVKGWAFDDGNDVWMGRTISEKSRLGYETFKVIEGWSNPKSKLQTNRQVIVDRGNRSGYSGIFSVEGKSCINRCFYVELIRGRKEETEVLWTSNSIVVFCGTSGTYGTGSWPDGADINLMPI

SEQ ID NO: 16423 - protein, 469 aa, Artificial Sequence
  neuraminidase__InfluenzaA__ACD93582
MNPNQKIITIGSVSLTISTICFFMQIAILATTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRGRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDKGNRSGYSGIFSVEGKSCINRCFYVELIRGRKEETEVLWTSNSIVVFCGTSGTYGTGSWPDGADINLMPI

SEQ ID NO: 16424 - protein, 469 aa, Artificial Sequence; identical to SEQ ID NO: 14712
  neuraminidase__InfluenzaA__ACF09403

SEQ ID NO: 16425 - protein, 469 aa, Artificial Sequence; identical to SEQ ID NO: 15929
  neuraminidase__InfluenzaA__ACF22151

SEQ ID NO: 16426 - protein, 469 aa, Artificial Sequence; identical to SEQ ID NO: 14095
  neuraminidase__InfluenzaA__ACF22246

SEQ ID NO: 16427 - protein, 469 aa, Artificial Sequence; identical to SEQ ID NO: 14095
  neuraminidase__InfluenzaA__ACF22257

SEQ ID NO: 16428 - protein, 469 aa, Artificial Sequence; identical to SEQ ID NO: 14095
  neuraminidase__InfluenzaA__ACF22279

SEQ ID NO: 16429 - protein, 469 aa, Artificial Sequence; identical to SEQ ID NO: 14095
  neuraminidase__InfluenzaA__ACF22290

SEQ ID NO: 16430 - protein, 469 aa, Artificial Sequence; identical to SEQ ID NO: 14095
  neuraminidase__InfluenzaA__ACF22301

SEQ ID NO: 16431 - protein, 469 aa, Artificial Sequence; identical to SEQ ID NO: 14095
  neuraminidase__InfluenzaA__ACF22312

SEQ ID NO: 16432 - protein, 469 aa, Artificial Sequence
  neuraminidase__InfluenzaA__ACF22323
MNPNQKIITIGSVSLTIATVCFLMQIAILVTTVTLHFKQYECDSPASNQVMPYEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 16433 - protein, 469 aa, Artificial Sequence; identical to SEQ ID NO: 14095
  neuraminidase__InfluenzaA__ACF22334

SEQ ID NO: 16434 - protein, 469 aa, Artificial Sequence; identical to SEQ ID NO: 14095
  neuraminidase__InfluenzaA__ACF22367

SEQ ID NO: 16435 - protein, 469 aa, Artificial Sequence
  neuraminidase__InfluenzaA__ACF22378
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCKNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 16436 - protein, 469 aa, Artificial Sequence
  neuraminidase__InfluenzaA__ACF22389
MNPNQKIITIGSVSLTIATVCFLMQIAILVTTVTLHFKQYECDSPASNQVMPCEPIIIERNITEIVYLNNTTIEKEICPKVVEYRNWSKPQCQITGFVPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 16437 - protein, 469 aa, Artificial Sequence
  neuraminidase__InfluenzaA__ACF22400
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLMDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 16438 - protein, 469 aa, Artificial Sequence; identical to SEQ ID NO: 16066
  neuraminidase__InfluenzaA__ACF22411

SEQ ID NO: 16439 - protein, 470 aa, Artificial Sequence
  neuraminidase__InfluenzaA__ACF33772
MNPNQKIITIGSISIAIGIISLMLQIGNIISIWASHSIQTGSQNHTGICNQRIITYENSTWVNHTYVNINNTNVVAGKDKTPVTLAGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYNGIITGTIKSWKKQILRTQESECVCMNGSCFTIMTDGPSNGAASYKIFKIEKGKVTKSMELNAPNFYYEECSCYPDTGTVMCVCRDNWHGSNRPWVSFNQNLDYQIGYICSGVFGDNPRPKDGEGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNSDIANWSWPDGAELPFTIDK

SEQ ID NO: 16440 - protein, 469 aa, Artificial Sequence
  neuraminidase__InfluenzaA__ACF33778
MNPNQKIITIGSVSLTISTICFFMQIAILITTVTLHFKQYEFSSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGIPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQNVEECSCYPRYPGVRCVCRDNWKGSNRPIVDINIKDYSIVSRYVCSGLVGDTPRKNDSSSSSHCLNPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16441 - protein, 469 aa, Artificial Sequence
  neuraminidase__InfluenzaA__ACF33785
MNPNQKIITIGSVSLTISTICFFMQIAILITTVTLHFKQYEFNSPPNNQVMLCEPTIIERNITEIVYLTNTTIEKEMCPKLAEYRNWSKPQCDITGFAPFSKDNSIRLSAGGDIWVTREPYVSCDPDKCYQFALGQGTTLNNVHSNDTVHVRTPYRTLLMNELGVPFHLGTKQVCIAWSSSSCHDGKAWLHVCVTGDDKNATASFIYNGRLVDSIVSWSKDILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16442 - protein, 470 aa, Artificial Sequence
  neuraminidase__InfluenzaA__ACF33787
MNPNQKIITIGSISIAIGIISLMLQIGNIISIWASHSIQTGSQNHTGICNQRIITYENSTWVNHTYVNINNTNVVAGKDKTPVTLAGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYNGIITGTIKSWKKQILRTQESECVCMNGSCFTIMTDGPGNGAASYKIFKIEKGKVTKSMELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPKENTTIWTSGSSISFCGVNSGIANWSWPDGAELPFTIDK

SEQ ID NO: 16443 - protein, 469 aa, Artificial Sequence; identical to SEQ ID NO: 15884
  neuraminidase__InfluenzaA__ACF33798

SEQ ID NO: 16444 - protein, 469 aa, Artificial Sequence; identical to SEQ ID NO: 16057
  neuraminidase__InfluenzaA__ACF41672

SEQ ID NO: 16445 - protein, 470 aa, Artificial Sequence; identical to SEQ ID NO: 16030
  neuraminidase__InfluenzaA__ACF41683

SEQ ID NO: 16446 - protein, 469 aa, Artificial Sequence
  neuraminidase__InfluenzaA__ACF41749
MNPNQKIITIGSVSLTIATVCFLMQIAILVTTVTLHFKQYECDSPASNQVMPCEPIIIERNITGIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 16447 - protein, 469 aa, Artificial Sequence
  neuraminidase__InfluenzaA__ACF41760
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDRGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 16448 - protein, 469 aa, Artificial Sequence
  neuraminidase__InfluenzaA__ACF41771
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVITDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 16449 - protein, 469 aa, Artificial Sequence; identical to SEQ ID NO: 14095
  neuraminidase__InfluenzaA__ACF41793

SEQ ID NO: 16450 - protein, 469 aa, Artificial Sequence; identical to SEQ ID NO: 14095
  neuraminidase__InfluenzaA__ACF41804

SEQ ID NO: 16451 - protein, 469 aa, Artificial Sequence; identical to SEQ ID NO: 14095
  neuraminidase__InfluenzaA__ACF41826

SEQ ID NO: 16452 - protein, 454 aa, Artificial Sequence; identical to SEQ ID NO: 15719
  neuraminidase__InfluenzaA__ACF41837

SEQ ID NO: 16453 - protein, 470 aa, Artificial Sequence
  neuraminidase__InfluenzaA__ACF41881
MNPNQKIITIGSISIAIGIISLMLQIGNIISIWASHSIQTGSQNHTGVCNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16454 - protein, 469 aa, Artificial Sequence; identical to SEQ ID NO: 15929
  neuraminidase__InfluenzaA__ACF41892

SEQ ID NO: 16455 - protein, 469 aa, Artificial Sequence; identical to SEQ ID NO: 14327
  neuraminidase__InfluenzaA__ACF41903

SEQ ID NO: 16456 - protein, 469 aa, Artificial Sequence
  neuraminidase__InfluenzaA__ACF41914
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYLGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16457 - protein, 470 aa, Artificial Sequence
  neuraminidase__InfluenzaA__ACF41925
MNPNQKIITIGSISMAIGIISLILQIGNIISIWASHSIQTGSQNHTGICNQRIITYENSTWVNQTYVNINNTNVVAGKDKTSVTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCVNGSCFTIMTDGPSNGAASYRIFKIEKGKVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSVKQDVVAMTDWSGYSGSFVQHPELTGLDCMRPCFWVELIRGRPRENTTIWTSGSSISFCGVNSDTANWSWPDGAELPFTIDK

SEQ ID NO: 16458 - protein, 470 aa, Artificial Sequence; identical to SEQ ID NO: 16457
  neuraminidase__InfluenzaA__ACF41936

SEQ ID NO: 16459 - protein, 469 aa, Artificial Sequence
  neuraminidase__InfluenzaA__ACF54392
MNPNQKIITIGSVSLTTATACFLTQIAILVTTVTLHFKQHECDSPASNQVMPCEPIIIERNITEIVYLNNTTIEKEICPKVVEYRNWSKPQCQITGFAPFSKDNSIRLSAGGDIWVTREPYVSCDSGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRFSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 16460 - protein, 469 aa, Artificial Sequence; identical to SEQ ID NO: 14095
  neuraminidase__InfluenzaA__ACF54403

SEQ ID NO: 16461 - protein, 469 aa, Artificial Sequence; identical to SEQ ID NO: 14095
  neuraminidase__InfluenzaA__ACF54414

SEQ ID NO: 16462 - protein, 469 aa, Artificial Sequence; identical to SEQ ID NO: 14095
  neuraminidase__InfluenzaA__ACF54425

SEQ ID NO: 16463 - protein, 469 aa, Artificial Sequence; identical to SEQ ID NO: 14095
  neuraminidase__InfluenzaA__ACF54436

SEQ ID NO: 16464 - protein, 469 aa, Artificial Sequence
  neuraminidase__InfluenzaA__ACF54447
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTKQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 16465 - protein, 469 aa, Artificial Sequence
  neuraminidase__InfluenzaA__ACF54469
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCMAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 16466 - protein, 469 aa, Artificial Sequence; identical to SEQ ID NO: 15760
  neuraminidase__InfluenzaA__ACF54480

SEQ ID NO: 16467 - protein, 469 aa, Artificial Sequence
  neuraminidase__InfluenzaA__ACF54502
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVSFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTINKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 16468 - protein, 469 aa, Artificial Sequence; identical to SEQ ID NO: 16467
  neuraminidase__InfluenzaA__ACF54513

SEQ ID NO: 16469 - protein, 469 aa, Artificial Sequence
  neuraminidase__InfluenzaA__ACF54524
MNPNQKIITIGSVSLTIATVCFFMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVSFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTINKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 16470 - protein, 469 aa, Artificial Sequence
  neuraminidase__InfluenzaA__ACF54535
MNPNQKIITIGSVSLIISTICFFMQTAILITTVTLHFKQYEFNSPPNNQVMLCEPTIIERNITKIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16471 - protein, 469 aa, Artificial Sequence; identical to SEQ ID NO: 14284
  neuraminidase__InfluenzaA__ACF54557

SEQ ID NO: 16472 - protein, 469 aa, Artificial Sequence; identical to SEQ ID NO: 15929
  neuraminidase__InfluenzaA__ACF54568

SEQ ID NO: 16473 - protein, 469 aa, Artificial Sequence
  neuraminidase__InfluenzaA__ACF54579
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVITDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16474 - protein, 453 aa, Artificial Sequence
  neuraminidase__InfluenzaA__ACF54601
MNPNQKIITIGSICMVVGIISLILQIGNIISIWISHSIQTGNQNHTGICNQGSITYKVVAGQDSTSVILTGNSSLCPIRGWAIHSKDNGIRIGSKGDVFVIREPFISCSHLECRTFFLTQGALLNDKHSRGTFKDRSPYRALMSCPVGEAPSPYNSRFESVAWSASACHDGMGWLTIGISGPDDGAVAVLKYNGIITETIKSWRKNILRTQESECTCVNGSCFTIMTDGPSDGLASYKIFKIEKGKVTKSIELNAPNSHYEECSCYPDTGKVMCVCRDNWHGSNRPWVSFDQNLDYKIGYICSGVFGDNPRPKDGTGSCGPVSADGANGVKGFSYKYGNGVWIGRTKSDSSRHGFEMIWDPNGWTETDSRFSMRQDVVAMTDRSGYSGSFVQHPELTGLDCMRPCFWVELIRGLPEENAIWTSGSIISFCGVNSDTVDWSWPDGAELPFTIDK

SEQ ID NO: 16475 - protein, 449 aa, Artificial Sequence
  neuraminidase__InfluenzaA__ACG50700
MNPNQKIITIGSICMVIGIVSLMLQIGNMISIWVSHSIQTGNQHQAEPISNTNFLTEKAVASVTLAGNSPLCPISGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDASEVTCVCRDNWHGSNRPWVSFNQNLEYQIGYICSGVFGDNPRPNDGTGSCGPVSTNGAYGVKGFSFKYGNGVWIGRTKSTNSRSGFEMIWDSNGWTGTDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 16476 - protein, 469 aa, Artificial Sequence; identical to SEQ ID NO: 16057
  neuraminidase__InfluenzaA__ACG70145

SEQ ID NO: 16477 - protein, 469 aa, Artificial Sequence; identical to SEQ ID NO: 15884
  neuraminidase__InfluenzaA__ACG70156

SEQ ID NO: 16478 - protein, 469 aa, Artificial Sequence
  neuraminidase__InfluenzaA__ACG80407
MNPNQKIITIGSVSLTISTICFFMQIAILITTVTLHFKQYEFNSPPNNQMMLCEPTIIERNITEIVYLTNTTIEKEICPKLAKYRNWSKPQCDITGFAPFSKDNSIRLSAGGDIWVTREPYVSCDPDKCYQFALGQGTTLNNVHSNDTARGRTPYRTLLMNELGVPFHLGTKQVCIAWSSSSCHDGKAWLHVCITGDDKNATASFIYNGRLVDSVVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16479 - protein, 469 aa, Artificial Sequence
  neuraminidase__InfluenzaA__ACG80411
MDSNSKIITIGSVSLTISTICFFMQIAILITTVTLHFKQYEFNSPPNNQMMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTAGGRTPYRTLLMNELGVPFHLGTKQVCIAWSSSSCHDGKAWLHVCITGDDKNATASFIYDGRLVDGVVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16480 - protein, 468 aa, Artificial Sequence
  neuraminidase__InfluenzaA__ACG80421
MNPIQKIITIGSVSLTISTICFFMQIAILITTVTLHFKQYEFNSPPNNQMMLCEPTIIERNITEIVYLTNTTIEKEICPKLAEYRNWSKPQCDITGFAPFSKDNSIRLSAGGDIWVTREPYVSCDPDKCYQFALGQGTTLNNVHSDTARDRTPYRTLLMNELGVPFHLGTKQVCIAWSSSSCHDGKAWLHVCITGDDKNATASFIYNGRLVDSVVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16481 - protein, 468 aa, Artificial Sequence
  neuraminidase__InfluenzaA__ACG80427
MDPNSKIITIGSVSLTISTICFFMQIAILITTVTLHFKQYEFNSPPNNQMMLCEPTIIERNITEIVYLTNTTIEKEICPKLAEYRNWSKPQCDITGFAPFSKDNSIRLSAGGDIWVTREPYVSCDPDKCYQFALGQGTTLNNVHSDTARDRTPYRTLLMNELGVPFHLGTKQVCIAWSSSSCHDGKAWLHVCITGDDKNATASFIYNGRLVDSVVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16482 - protein, 469 aa, Artificial Sequence
  neuraminidase__InfluenzaA__ACG80437
MNPNQKIITIGSVSLTISTICFFMQIAILITTVTLHFKQYEFNSSPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATANFIYNGRLVDSIVSWSKEIFRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRSGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16483 - protein, 468 aa, Artificial Sequence
  neuraminidase__InfluenzaA__ACG80446
MNPNQKIITIGSVSLTISTICFFMQIAILITTVTLHFKQYEFNSPPNNQMMLCEPTIIERNITEIVYLTNTTIEKEICPKLAEYRNWSKPQCDITGFAPFSKDNSIRLSAGGDIWVTREPYVSCDPDKCYQFALGQGTTLNNVHSDTARDRTPYRTLLMNELGVPFHLGTKQVCIAWSSSSCHDGKAWLHVCITGDDKNATASFIYNGRLVDSVVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16484 - protein, 469 aa, Artificial Sequence
  neuraminidase__InfluenzaA__ACG80455
MNPNQKIITIGSVSFIISSICFFMQIAILITTVTLHFKQYEFNSPPNNQMMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTARGRTPYRTLLMNELGVPFHLGTKQVCIAWSSSSCHDGKAWLHVCITGDDKNATASFIYDGRLVDSVVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16485 - protein, 468 aa, Artificial Sequence; identical to SEQ ID NO: 16483
  neuraminidase__InfluenzaA__ACG80464

SEQ ID NO: 16486 - protein, 469 aa, Artificial Sequence
  neuraminidase__InfluenzaA__ACG80473
MDPIQKIITIGSVSLTISTICFFMQIAILITTVTLHFKQYEFNSPPNNQMMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTARGRTPYRTLLMNELGVPFHLGTKQVCIAWSSSSCHDGKAWLHVCITGDDKNATASFIYDGRLVDSVVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16487 - protein, 469 aa, Artificial Sequence; identical to SEQ ID NO: 14712
  neuraminidase__InfluenzaA__ACH69559

SEQ ID NO: 16488 - protein, 469 aa, Artificial Sequence
  neuraminidase__InfluenzaA__ACH69570
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRNNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16489 - protein, 469 aa, Artificial Sequence; identical to SEQ ID NO: 14712
  neuraminidase__InfluenzaA__ACH69581

SEQ ID NO: 16490 - protein, 469 aa, Artificial Sequence
  neuraminidase__InfluenzaA__ACH69592
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSPLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIVDRGNRSGYSGIFSVEGKSCINQCFYVELIRGRKQETEVLWTSNSIVVFCGTSGTYGTGSWPDGADLNLMPI

SEQ ID NO: 16491 - protein, 469 aa, Artificial Sequence
  neuraminidase__InfluenzaA__ACH69603
MNPNQKIITIGSVSLTIATICFLMQIVILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSPLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIVDRGNRSGYSGIFSVEGKSCINRCFYVELIRGRKQETEVLWTSNSIVVFCGTSGTYGTGSWPDGADLNLMPI

SEQ ID NO: 16492 - protein, 469 aa, Artificial Sequence
  neuraminidase__InfluenzaA__ACH69614
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSPLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIVDRGNRSGYSGIFSVEGKSCINRCFYVELIRGRKQETEVLWTSNSIVVFCGTSGTYGTGSWPDGADLNLMPI

SEQ ID NO: 16493 - protein, 470 aa, Artificial Sequence
  neuraminidase__InfluenzaA__ACI22525
MNPNQKIITIGSISIAIGIISLMLQIGNIISIWASHSIQTGSQNHTGICNQRIITYENSTWVNNTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCMNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16494 - protein, 470 aa, Artificial Sequence; identical to SEQ ID NO: 16493
  neuraminidase__InfluenzaA__ACI22526

SEQ ID NO: 16495 - protein, 470 aa, Artificial Sequence; identical to SEQ ID NO: 16493
  neuraminidase__InfluenzaA__ACI22527

SEQ ID NO: 16496 - protein, 470 aa, Artificial Sequence; identical to SEQ ID NO: 16493
  neuraminidase__InfluenzaA__ACI22528

SEQ ID NO: 16497 - protein, 470 aa, Artificial Sequence; identical to SEQ ID NO: 16493
  neuraminidase__InfluenzaA__ACI22529

SEQ ID NO: 16498 - protein, 470 aa, Artificial Sequence; identical to SEQ ID NO: 16493
  neuraminidase__InfluenzaA__ACI22530

SEQ ID NO: 16499 - protein, 470 aa, Artificial Sequence
  neuraminidase__InfluenzaA__ACI22532
MNPNQKIITIGSISIAIGIISLMLQIGNIISIWASHSIQTGSQNHTGICNQRIITYENSTWVNNTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCMNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16500 - protein, 470 aa, Artificial Sequence; identical to SEQ ID NO: 16499
  neuraminidase__InfluenzaA__ACI22533

SEQ ID NO: 16501 - protein, 470 aa, Artificial Sequence; identical to SEQ ID NO: 16493
  neuraminidase__InfluenzaA__ACI22534

SEQ ID NO: 16502 - protein, 469 aa, Artificial Sequence
  neuraminidase__InfluenzaA__ACI25727
MNPNQKIITIGSVSLTIATVCFLMQIAILVTTVTLHFKQHECNSPASNQVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIKEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 16503 - protein, 469 aa, Artificial Sequence
  neuraminidase__InfluenzaA__ACI25749
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMHI

SEQ ID NO: 16504 - protein, 469 aa, Artificial Sequence; identical to SEQ ID NO: 16503
  neuraminidase__InfluenzaA__ACI25760

SEQ ID NO: 16505 - protein, 469 aa, Artificial Sequence; identical to SEQ ID NO: 16503
  neuraminidase__InfluenzaA__ACI25771

SEQ ID NO: 16506 - protein, 469 aa, Artificial Sequence; identical to SEQ ID NO: 14095
  neuraminidase__InfluenzaA__ACI25782

SEQ ID NO: 16507 - protein, 469 aa, Artificial Sequence
  neuraminidase__InfluenzaA__ACI25793
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSVGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 16508 - protein, 469 aa, Artificial Sequence
  neuraminidase__InfluenzaA__ACI25804
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDHRSGYSGIFSVEGKSCINRCFYVELIRGRKQETRVWWTSNSIVVFCGTSGTYGTGSWPDGANINFMPI

SEQ ID NO: 16509 - protein, 469 aa, Artificial Sequence; identical to SEQ ID NO: 16467
  neuraminidase__InfluenzaA__ACI26277

SEQ ID NO: 16510 - protein, 469 aa, Artificial Sequence; identical to SEQ ID NO: 14327
  neuraminidase__InfluenzaA__ACI26299

SEQ ID NO: 16511 - protein, 469 aa, Artificial Sequence
  neuraminidase__InfluenzaA__ACI26321
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSTVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16512 - protein, 469 aa, Artificial Sequence
  neuraminidase__InfluenzaA__ACI26354
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16513 - protein, 469 aa, Artificial Sequence
  neuraminidase__InfluenzaA__ACI26365
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLTGSAQHVEECSCYPRYPGVRCVCRDNWKGSNRPIVDINIKDHSIVSSYVCSGLVGDTPRKNDSSSSSHCLDPNNEEGVHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16514 - protein, 469 aa, Artificial Sequence; identical to SEQ ID NO: 16512
  neuraminidase__InfluenzaA__ACI26376

SEQ ID NO: 16515 - protein, 469 aa, Artificial Sequence; identical to SEQ ID NO: 16404
  neuraminidase__InfluenzaA__ACI26387

SEQ ID NO: 16516 - protein, 469 aa, Artificial Sequence; identical to SEQ ID NO: 16416
  neuraminidase__InfluenzaA__ACI26420

SEQ ID NO: 16517 - protein, 469 aa, Artificial Sequence; identical to SEQ ID NO: 14327
  neuraminidase__InfluenzaA__ACI26431

SEQ ID NO: 16518 - protein, 470 aa, Artificial Sequence
  neuraminidase__InfluenzaA__ACI26442
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDREGSCNPVTIDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16519 - protein, 470 aa, Artificial Sequence; identical to SEQ ID NO: 16518
  neuraminidase__InfluenzaA__ACI26453

SEQ ID NO: 16520 - protein, 469 aa, Artificial Sequence
  neuraminidase__InfluenzaA__ACI26464
MNPNQKIITIGSVSLTISTICFFMQIAILIATVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSTVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16521 - protein, 469 aa, Artificial Sequence; identical to SEQ ID NO: 16511
  neuraminidase__InfluenzaA__ACI26475

SEQ ID NO: 16522 - protein, 469 aa, Artificial Sequence; identical to SEQ ID NO: 16512
  neuraminidase__InfluenzaA__ACI26486

SEQ ID NO: 16523 - protein, 469 aa, Artificial Sequence; identical to SEQ ID NO: 16512
  neuraminidase__InfluenzaA__ACI26497

SEQ ID NO: 16524 - protein, 469 aa, Artificial Sequence; identical to SEQ ID NO: 16512
  neuraminidase__InfluenzaA__ACI26508

SEQ ID NO: 16525 - protein, 469 aa, Artificial Sequence
  neuraminidase__InfluenzaA__ACI26519
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 16526 - protein, 469 aa, Artificial Sequence; identical to SEQ ID NO: 16512
  neuraminidase__InfluenzaA__ACI26530

SEQ ID NO: 16527 - protein, 469 aa, Artificial Sequence; identical to SEQ ID NO: 16512
  neuraminidase__InfluenzaA__ACI26541

SEQ ID NO: 16528 - protein, 469 aa, Artificial Sequence
  neuraminidase__InfluenzaA__ACI26552
MNPNQKIITIGSVSLTIATMCFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTISEELRSGYETFKVIGGWSTPNSKLQINRQVIVDSGNRSGYSGIFSVEGKSCINRCFYVELIRGREQETRVWWTSNSIVVFCGTSGTYGTGSWPDGADINLMPI

SEQ ID NO: 16529 - protein, 469 aa, Artificial Sequence
  neuraminidase__InfluenzaA__ACI26574
MNPNQKIITIGSVSLTLATICFLMQIAILVTTVTLHFKQYECSSPPNNQVMPCEPTIIERNITEIVYLTNITIEKEICPKLVEYRNWSKPQCKITGFAPFSKDNSIRLSAGGDIWVTREPYVSCDPSKCYQFALGQGTTLNNRHSNDTVHDRTPYRTLLMNELGVPFHLGTRQVCMAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETRVWWTSNSIVVFCGTSGTYGTGSWPDGADINLMPI

SEQ ID NO: 16530 - protein, 469 aa, Artificial Sequence
  neuraminidase__InfluenzaA__ACI26585
MNPNQKIITIGSVSLTIATICFLMQIAILVTTVTLHFKQHECNSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIVSWSKNVLRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQTNRQVIVDRGNRSGYSGIFSVEGKSCINRCFYVELIRGRKQETKVWWTSNSIVVFCGTSGTYGTGSWPDGADINLMPI

SEQ ID NO: 16531 - protein, 470 aa, Artificial Sequence
  neuraminidase__InfluenzaA__ACI32764
MNPNQKIITIGSISMAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16532 - protein, 470 aa, Artificial Sequence
  neuraminidase__InfluenzaA__ACI32765
MNPNQKIITIGSISIAIGIISLMLQIGNIISIWASHSIQTGSQNHTGICNQRIITYENNTWVNHTYVNINNTNVVARKDKTSVTLAGNSSLCSISGWAIYTKDNSIRIGSKGDVFVIREPFISCSHLECRTFFMTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSVELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16533 - protein, 470 aa, Artificial Sequence; identical to SEQ ID NO: 14386
  neuraminidase__InfluenzaA__ACI32766

SEQ ID NO: 16534 - protein, 470 aa, Artificial Sequence
  neuraminidase__InfluenzaA__ACI32767
MNPNQKIITIGSISIAIGIISLMLQIGNIISIWASHSTQTGSQNHTGICNQRIITYENSTWVNHTYVNINNTNVVAGKDKTSVTLAGNSSLCSISGWAIYTKDNSVRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16535 - protein, 470 aa, Artificial Sequence
  neuraminidase__InfluenzaA__ACI32768
MNPNQKIITIGSISIAIGIISLMSQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16536 - protein, 470 aa, Artificial Sequence
  neuraminidase__InfluenzaA__ACI32769
MNPNQKIITIGSISIAIGIISLMLQIGNIISIWASHSIQTGSQNHTGICNQRIITYENSTWVNHTYVNINNTNVVAGKDKISVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16537 - protein, 470 aa, Artificial Sequence; identical to SEQ ID NO: 14386
  neuraminidase__InfluenzaA__ACI32770

SEQ ID NO: 16538 - protein, 470 aa, Artificial Sequence
  neuraminidase__InfluenzaA__ACI32771
MNPNQKIITIGSISIAIGIISLMLQIGNIISIWASHSIQTGSQNHTGICNQRIITYKNSTWVNHTYVNINNTNVVAGKGKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16539 - protein, 470 aa, Artificial Sequence; identical to SEQ ID NO: 14386
  neuraminidase__InfluenzaA__ACI32772

SEQ ID NO: 16540 - protein, 470 aa, Artificial Sequence; identical to SEQ ID NO: 14386
  neuraminidase__InfluenzaA__ACI32773

SEQ ID NO: 16541 - protein, 470 aa, Artificial Sequence; identical to SEQ ID NO: 14386
  neuraminidase__InfluenzaA__ACI32774

SEQ ID NO: 16542 - protein, 470 aa, Artificial Sequence; identical to SEQ ID NO: 14386
  neuraminidase__InfluenzaA__ACI32775

SEQ ID NO: 16543 - protein, 470 aa, Artificial Sequence
  neuraminidase__InfluenzaA__ACI32776
MNPNQKIITIGSISIAIGIISLMLQIGNIISIWASHSIQTGSQNHTGICNQRIITYKNSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16544 - protein, 470 aa, Artificial Sequence
  neuraminidase__InfluenzaA__ACI32777
MNPNQKIITIGSISIAIGIISLMLQIGNIISIWASHSIQTGSQNHTGICNQRIITYKNSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFAIDK

SEQ ID NO: 16545 - protein, 470 aa, Artificial Sequence; identical to SEQ ID NO: 14386
  neuraminidase__InfluenzaA__ACI32778

SEQ ID NO: 16546 - protein, 470 aa, Artificial Sequence; identical to SEQ ID NO: 14386
  neuraminidase__InfluenzaA__ACI32779

SEQ ID NO: 16547 - protein, 470 aa, Artificial Sequence; identical to SEQ ID NO: 14386
  neuraminidase__InfluenzaA__ACI32780

SEQ ID NO: 16548 - protein, 470 aa, Artificial Sequence; identical to SEQ ID NO: 14386
  neuraminidase__InfluenzaA__ACI32781

SEQ ID NO: 16549 - protein, 470 aa, Artificial Sequence
  neuraminidase__InfluenzaA__ACI32782
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNGAASYKIFKIEKGKATKSIELNAPNFHYEECSCYPDTGTVMCVCRDNWHGSNRPWVSFNQNLDYQIGYICSGVFGDNPRPKDRKGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16550 - protein, 470 aa, Artificial Sequence
  neuraminidase__InfluenzaA__ACI32783
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWLSFNQNLDYQIGYICSGVIGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDGDTANWSWPDGAELPFTIDK

SEQ ID NO: 16551 - protein, 470 aa, Artificial Sequence
  neuraminidase__InfluenzaA__ACI32784
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNGAASYKIFKIEKGKATKSIELNAPNFHYEECSCYPDTGTVMCVCRDNWHGSNRPWVSFNQNLDYQIGYICSGVFGDNPRPKDREGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16552 - protein, 470 aa, Artificial Sequence
  neuraminidase__InfluenzaA__ACI32785
MNPNQKIITIGSISIAIGIISLMLQIGNIISIWASHSIQTGSQNHTGMCNQRIITYENSTWVNHTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWADTDSDFSVKQDVVAITDWSGYSGSFVQHPELTGLNCIRPCFWVELVRGLPRENTTIWTSGSSISFCGVDSDTANWSWPDGAELPFTIDK

SEQ ID NO: 16553 - protein, 470 aa, Artificial Sequence
  neuraminidase__InfluenzaA__ACI32787
MNPNQKIITIGSISIAIGIISLILQIGNIISIWASHSIQTGSQNHTGICNQRIITYENSTWVNNTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGAASYKIFKIEKGKVTKTIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNGGTADWSWPDGAELPFTIDK

SEQ ID NO: 16554 - protein, 470 aa, Artificial Sequence
  neuraminidase__InfluenzaA__ACI32788
MNPNQKIITIGSISIAIGIISLMLQIGNIISIWASHSIQTGSQNHTGTCNQRIITYENNTWVNHTCVNINNTNVVAGKDKTSVTLVGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGKGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPMTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16555 - protein, 469 aa, Artificial Sequence
  neuraminidase__InfluenzaA__ACI32790
MNPNQKIITIGSVSLTIATICFLTQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRNQETEVLWTSNSIVVFCGTSGTYGTGSWPDGADINLMPI

SEQ ID NO: 16556 - protein, 469 aa, Artificial Sequence; identical to SEQ ID NO: 14382
  neuraminidase__InfluenzaA__ACI32791

SEQ ID NO: 16557 - protein, 469 aa, Artificial Sequence; identical to SEQ ID NO: 14382
  neuraminidase__InfluenzaA__ACI32793

SEQ ID NO: 16558 - protein, 469 aa, Artificial Sequence; identical to SEQ ID NO: 14382
  neuraminidase__InfluenzaA__ACI32794

SEQ ID NO: 16559 - protein, 469 aa, Artificial Sequence; identical to SEQ ID NO: 14712
  neuraminidase__InfluenzaA__ACI32795

SEQ ID NO: 16560 - protein, 469 aa, Artificial Sequence
  neuraminidase__InfluenzaA__ACI32796
MNPNQKIITIGSVSLTISTICFFMQIAILITTVTLHFKQYEFNSPPNNQVMLCEPTIIERNITEIVYLTNTTIEKEICPKLAEYRNWSKPQCSITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16561 - protein, 469 aa, Artificial Sequence
  neuraminidase__InfluenzaA__ACI32797
MNPNQMIITIGSVSLTISTICFFMQIAILITTVTLHFKQYEFNSPPNNQVMLCEPTIIERNITEIVYLTNTTIEKEICPKLAEYRNWSKPQCSITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16562 - protein, 469 aa, Artificial Sequence
  neuraminidase__InfluenzaA__ACI32798
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSNEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16563 - protein, 469 aa, Artificial Sequence
  neuraminidase__InfluenzaA__ACI32799
MNPNQRIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSVVSWSKDILRTQESECVCINGTCTVVMTDGSASGKANTKILFIEEGKIVHTSTLSGSAQHVEECSCYPRYPGVRCVCRDNWKGSNRPIVDINIKNYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16564 - protein, 469 aa, Artificial Sequence
  neuraminidase__InfluenzaA__ACI32800
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 16565 - protein, 469 aa, Artificial Sequence; identical to SEQ ID NO: 16564
  neuraminidase__InfluenzaA__ACI32802

SEQ ID NO: 16566 - protein, 469 aa, Artificial Sequence; identical to SEQ ID NO: 16564
  neuraminidase__InfluenzaA__ACI32803

SEQ ID NO: 16567 - protein, 469 aa, Artificial Sequence; identical to SEQ ID NO: 15707
  neuraminidase__InfluenzaA__ACI32804

SEQ ID NO: 16568 - protein, 469 aa, Artificial Sequence
  neuraminidase__InfluenzaA__ACI32805
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKAVTKILFIEEGKIVHTSTLSGSAQHVEECSCYPRYPGVRCVCRDNWKGSNRPIVDINIKDYSIVSSYVCSGLVGDTPRKNDRSSSSHCLDPNNEEGGHGVKGWAFDDGNDVWMGRTISEKSRSGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 16569 - protein, 469 aa, Artificial Sequence; identical to SEQ ID NO: 14712
  neuraminidase__InfluenzaA__ACI32806

SEQ ID NO: 16570 - protein, 469 aa, Artificial Sequence
  neuraminidase__InfluenzaA__ACI32807
MNPNQKIITIGSVSLTISTICFFMQIAILITTVTLHFKQYEFNSPPNNQVMLCEPTIIERNITEIVYLTNTTIEKEVCPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16571 - protein, 469 aa, Artificial Sequence
  neuraminidase__InfluenzaA__ACI32808
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKNYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEKTEVLWTSNSIVVFCGTSGTYGTGSWPDGADINLMPI

SEQ ID NO: 16572 - protein, 469 aa, Artificial Sequence; identical to SEQ ID NO: 15707
  neuraminidase__InfluenzaA__ACI32809

SEQ ID NO: 16573 - protein, 469 aa, Artificial Sequence
  neuraminidase__InfluenzaA__ACI32810
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPHRTLLMNELGVPFHLGTKQVCIAWSSSSCHDGKAWLHVCVTGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKNYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16574 - protein, 469 aa, Artificial Sequence
  neuraminidase__InfluenzaA__ACI32811
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16575 - protein, 469 aa, Artificial Sequence
  neuraminidase__InfluenzaA__ACI32812
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSVVSWSKDILRTQESECVCINGTCTVVMTDGSASGKANTKILFIEEGKIVHTSTLSGSAQHVEECSCYPRYPGVRCVCRDNWKGSNRPIVDINIKNYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16576 - protein, 469 aa, Artificial Sequence; identical to SEQ ID NO: 14799
  neuraminidase__InfluenzaA__ACI32814

SEQ ID NO: 16577 - protein, 449 aa, Artificial Sequence
  neuraminidase__InfluenzaA__ACJ53848
MNPNQKIITIGSICMVIGIVSLMLQIGNMISIWVSHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 16578 - protein, 449 aa, Artificial Sequence
  neuraminidase__InfluenzaA__ACJ53849
MNPNQKIITIGSICMVIGIVSLMLQIGNMISIWVSHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCSPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 16579 - protein, 449 aa, Artificial Sequence
  neuraminidase__InfluenzaA__ACJ53853
MNPNQKIITIGSICMVIGIVSLMLQIGNMISIWVSHSIQTGNQCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 16580 - protein, 449 aa, Artificial Sequence; identical to SEQ ID NO: 16579
  neuraminidase__InfluenzaA__ACJ53866

SEQ ID NO: 16581 - protein, 449 aa, Artificial Sequence
  neuraminidase__InfluenzaA__ACJ53867
MNPNQKIITIGSICMAIGIVSLMLQIGNMISLWVSHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 16582 - protein, 449 aa, Artificial Sequence
  neuraminidase__InfluenzaA__ACJ53875
MNPNQKIITIGSICMVIGIVSLMLQIGNMISIWVSHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGISWLTIGISGPDNGAVAVLKYNGIITDTIKSWRNNILRTQESECACVNGSCFTVMTDGPSSGQASYKIFKMEKGKVVKSVELEAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 16583 - protein, 449 aa, Artificial Sequence
  neuraminidase__InfluenzaA__ACJ53876
MNPNQKIITIGSICMVIGIVSLMLQIGNIISIWVSHSIQTGNQCQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 16584 - protein, 467 aa, Artificial Sequence
  neuraminidase__InfluenzaA__ACJ67535
MNPNQKIIALGSVSITIATICLIMQIAVLATTMTLHFNECTNPSNNQAMPCEPIIIERNMTEIVHLNNTTIEKESCPKVAEYKNWSKPQCQITGFAPFSKDNSIRLSAGGDIWVTREPYVSCGLGNCYQFALGQGTTLNNKHSNDTIHDRSPHRTLLMNELGVPFHLGTKQVCIAWSSSSCHDGKAWLHVCVTGDDRNATASIIYDGMLTDSIGSWSKNILRTQESECVCINGTCTVVMTDGSASGRADTKILFIREGKIVHISPLSGSAQHVEECSCYPRYPEVRCVCRDNWKGSNRPVLYINVADYSVDSSYVCSGLVGDTPRNDDSSSSSNCRDPNNERGGPGVKGWAFDNGNDVWMGRTIKKDSRSGYETFRVVGGWTTANSKSQINRQVIVDSDNWSGYSGIFSVEGKTCINRCFYVELIRGRPQETRVWWTSNSIIVFCGTSGTYGTGSWPDGANINFMSI

SEQ ID NO: 16585 - protein, 469 aa, Artificial Sequence
  neuraminidase__InfluenzaA__ACK99424
MNPNQKIITIGSVSLTIATICFLMQIAILVTTVTLHFKQYECSSPPNNQVIPCQPTIIERNITEIVYLTNTTIEKEICPKLVEYRNWSKPQCKITGFAPFSKDNSIRLSAGGDIWVTREPYVSCDPSKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKVVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSTPNSKLQINRQVIVDSGNRSGYSGIFSVEGKSCINRCFYVELIRGRKQETKVWWTSNSIVVFCGTSGTYGTGSWPDGADINLMPI

SEQ ID NO: 16586 - protein, 469 aa, Artificial Sequence; identical to SEQ ID NO: 16405
  neuraminidase__InfluenzaA__ACK99435

SEQ ID NO: 16587 - protein, 470 aa, Artificial Sequence
  neuraminidase__InfluenzaA__ACK99446
MNPNQKIITIGSISMAIGIISLTLQIGNIISIWVSHSIQTGSQNHTGICNQRIITYENSTWVNQTYVNINNTNVVAGKDKTSVTLAGNSSLCPIRGWAIYTKDNSIRIGSKGDVFVIREPFISCSHLECRTFFLTQGALLNDKHSNGTVKDRSPHRALMSCPLGEAPSPYNSRFESVAWSASACHDGMGWLTIGISGPDDGAVAVLKYNGIITETIKSWKKRILRTQESECVCVNGSCFTIMTDGPSNGAASYRIFKIEKGKVTKSIELDAPNSHYEECSCYPDTGTVMCVCRDNWHGSNRPWVSFNQNLDYQIGYICSGVFGDNPRPKDGKGSCNPVTVDGADGVKGFSYRYGNGVWIGRTKSNRFRKGFEMIWDPNGWTDTDSDFSVKQDVVAMTDWSGYSGSFVQHPELTGLDCMRPCFWVELVRGRPRENTTIWTSGSSISFCGVNSDTANWSWPDGAELPFTIDK

SEQ ID NO: 16588 - protein, 469 aa, Artificial Sequence
  neuraminidase__InfluenzaA__ACK99457
MNPNQKIITIGSVSLTIATICFLMQIAILVTTVTLHFKQHECNSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIVSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQTNRQVIVDRGNRSGYSGIFSVEGKSCINRCFYVELIRGRKQETKVWWTSNSIVVFCGTSGTYGTGSWPDGADINLMPI

SEQ ID NO: 16589 - protein, 470 aa, Artificial Sequence
  neuraminidase__InfluenzaA__ACK99468
MNPNQKIITIGSISIAIGIISLILQIGNIISIWASHSIQTGSQNHTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNSSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 16590 - protein, 469 aa, Artificial Sequence
  neuraminidase__InfluenzaA__ACK99479
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLLGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGANINLMPI

SEQ ID NO: 16591 - protein, 470 aa, Artificial Sequence; identical to SEQ ID NO: 16284
  neuraminidase__InfluenzaA__ACL12066

SEQ ID NO: 16592 - protein, 469 aa, Artificial Sequence; identical to SEQ ID NO: 15185
  neuraminidase__InfluenzaA__ACL12132

SEQ ID NO: 16593 - protein, 470 aa, Artificial Sequence; identical to SEQ ID NO: 16518
  neuraminidase__InfluenzaA__ACL12154

SEQ ID NO: 16594 - protein, 469 aa, Artificial Sequence; identical to SEQ ID NO: 16512
  neuraminidase__InfluenzaA__ACL12165

SEQ ID NO: 16595 - protein, 469 aa, Artificial Sequence; identical to SEQ ID NO: 16512
  neuraminidase__InfluenzaA__ACL12176

SEQ ID NO: 16596 - protein, 469 aa, Artificial Sequence
  neuraminidase__InfluenzaA__ACL12198
MNPNQKIITIGSVSLTISTICFFMQIAILITTVTLHFKQYEFNSTPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16597 - protein, 469 aa, Artificial Sequence; identical to SEQ ID NO: 16090
  neuraminidase__InfluenzaA__ACL12209

SEQ ID NO: 16598 - protein, 469 aa, Artificial Sequence; identical to SEQ ID NO: 16512
  neuraminidase__InfluenzaA__ACL12220

SEQ ID NO: 16599 - protein, 469 aa, Artificial Sequence
  neuraminidase__InfluenzaA__ACL12242
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16600 - protein, 470 aa, Artificial Sequence
  neuraminidase__InfluenzaA__ACL12264
MNPNQKIITIGSISMAIGIISLILQIVNIISIWVSHSIQTGSQNHTGICNQRIITYENSTWVNQTYVNINNTNVVAGKDKTSVTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDDGAVAVLKYNGIITETIKSWKKRILRTQESECVCVNGSCFTIMTDGPSNGAASYRIFKIEKGKVTKSIELDAPNSHYEECSCYPDTGTVMCVCRDNWHGSNRPWVSFNQNLDYQIGYICSGVFGDNPRPKDGKGSCDPVTVDGADGVKGFSYRYGNGVWIGRTKSNRFRKGFEMIWDPNGWTDTDSDFSVKQDVVAMTDWSGYSGSFVQHPELTGLDCMRPCFWVELVRGRPRENTTIWTSGSSISFCGVNSDTANWSWPDGAELPFTIDK

SEQ ID NO: 16601 - protein, 469 aa, Artificial Sequence; identical to SEQ ID NO: 16405
  neuraminidase__InfluenzaA__ACN32275

SEQ ID NO: 16602 - protein, 469 aa, Artificial Sequence
  neuraminidase__InfluenzaA__ACN32286
MNPNKKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLLGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16603 - protein, 469 aa, Artificial Sequence
  neuraminidase__InfluenzaA__ACN32493
MNPNQKIITIGSVSLTISTICFFMQIAILITTVTLHFKQYEFNSSPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16604 - protein, 469 aa, Artificial Sequence; identical to SEQ ID NO: 14154
  neuraminidase__InfluenzaA__ACN32526

SEQ ID NO: 16605 - protein, 469 aa, Artificial Sequence
  neuraminidase__InfluenzaA__ACN32537
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPDVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIDGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 16606 - protein, 470 aa, Artificial Sequence; identical to SEQ ID NO: 16082
  neuraminidase__InfluenzaA__ACN32807

SEQ ID NO: 16607 - protein, 470 aa, Artificial Sequence; identical to SEQ ID NO: 16030
  neuraminidase__InfluenzaA__ACN32818

SEQ ID NO: 16608 - protein, 470 aa, Artificial Sequence; identical to SEQ ID NO: 16030
  neuraminidase__InfluenzaA__ACN32829

SEQ ID NO: 16609 - protein, 470 aa, Artificial Sequence
  neuraminidase__InfluenzaA__ACN32840
MNPNQKIITIGSISIAIGIISLMLQIGNIISIWASHSIQTGSQNHTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTVNWSWPDGAELPFTIDK

SEQ ID NO: 16610 - protein, 469 aa, Artificial Sequence; identical to SEQ ID NO: 16512
  neuraminidase__InfluenzaA__ACN32851

SEQ ID NO: 16611 - protein, 469 aa, Artificial Sequence; identical to SEQ ID NO: 16599
  neuraminidase__InfluenzaA__ACN32862

SEQ ID NO: 16612 - protein, 469 aa, Artificial Sequence; identical to SEQ ID NO: 16603
  neuraminidase__InfluenzaA__ACN32873

SEQ ID NO: 16613 - protein, 469 aa, Artificial Sequence; identical to SEQ ID NO: 16599
  neuraminidase__InfluenzaA__ACN32884

SEQ ID NO: 16614 - protein, 469 aa, Artificial Sequence; identical to SEQ ID NO: 16603
  neuraminidase__InfluenzaA__ACN32895

SEQ ID NO: 16615 - protein, 469 aa, Artificial Sequence; identical to SEQ ID NO: 16512
  neuraminidase__InfluenzaA__ACN32906

SEQ ID NO: 16616 - protein, 469 aa, Artificial Sequence
  neuraminidase__InfluenzaA__ACN32917
MNPNQKIITIGSVSLTISTICFFMQIAILITTVTLHFKQYEFNSPPNNQVMLCKPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINITDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16617 - protein, 469 aa, Artificial Sequence
  neuraminidase__InfluenzaA__ACN32928
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINITDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16618 - protein, 469 aa, Artificial Sequence; identical to SEQ ID NO: 16603
  neuraminidase__InfluenzaA__ACN32939

SEQ ID NO: 16619 - protein, 469 aa, Artificial Sequence; identical to SEQ ID NO: 16512
  neuraminidase__InfluenzaA__ACN32950

SEQ ID NO: 16620 - protein, 469 aa, Artificial Sequence
  neuraminidase__InfluenzaA__ACN32961
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINITDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINIMPI

SEQ ID NO: 16621 - protein, 469 aa, Artificial Sequence; identical to SEQ ID NO: 16599
  neuraminidase__InfluenzaA__ACN32972

SEQ ID NO: 16622 - protein, 469 aa, Artificial Sequence; identical to SEQ ID NO: 16599
  neuraminidase__InfluenzaA__ACN32994

SEQ ID NO: 16623 - protein, 469 aa, Artificial Sequence
  neuraminidase__InfluenzaA__ACN33005
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGESCINRCFYVELIRGRKEETEVLWTSNSIVVFCGTSGTYGTGSWPDGADINLMPI

SEQ ID NO: 16624 - protein, 469 aa, Artificial Sequence; identical to SEQ ID NO: 16599
  neuraminidase__InfluenzaA__ACN33016

SEQ ID NO: 16625 - protein, 469 aa, Artificial Sequence; identical to SEQ ID NO: 16599
  neuraminidase__InfluenzaA__ACN33049

SEQ ID NO: 16626 - protein, 469 aa, Artificial Sequence; identical to SEQ ID NO: 16599
  neuraminidase__InfluenzaA__ACN33060

SEQ ID NO: 16627 - protein, 469 aa, Artificial Sequence; identical to SEQ ID NO: 16603
  neuraminidase__InfluenzaA__ACN33082

SEQ ID NO: 16628 - protein, 470 aa, Artificial Sequence; identical to SEQ ID NO: 16069
  neuraminidase__InfluenzaA__ACN33093

SEQ ID NO: 16629 - protein, 470 aa, Artificial Sequence; identical to SEQ ID NO: 16030
  neuraminidase__InfluenzaA__ACN33104

SEQ ID NO: 16630 - protein, 469 aa, Artificial Sequence; identical to SEQ ID NO: 16603
  neuraminidase__InfluenzaA__ACN33115

SEQ ID NO: 16631 - protein, 470 aa, Artificial Sequence
  neuraminidase__InfluenzaA__ACN33126
MNPNQKIITIGSISIAIGIISLMLQIGNIISIWASHSIQTGSQNNTGICNQRIITYENSTWVNHTYVNINNTNVVAGEDKTSVTLAGSSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16632 - protein, 470 aa, Artificial Sequence
  neuraminidase__InfluenzaA__ACN33148
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16633 - protein, 469 aa, Artificial Sequence
  neuraminidase__InfluenzaA__ACN33159
MNPNQKIITIGSVSLTISTICFFMQIAILITTVTLHFKQYEFNSPPNNQVMLCEPTIIERNITEIVYLTNTTIEKEKCPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16634 - protein, 469 aa, Artificial Sequence; identical to SEQ ID NO: 16512
  neuraminidase__InfluenzaA__ACN33170

SEQ ID NO: 16635 - protein, 469 aa, Artificial Sequence; identical to SEQ ID NO: 16603
  neuraminidase__InfluenzaA__ACN33181

SEQ ID NO: 16636 - protein, 469 aa, Artificial Sequence; identical to SEQ ID NO: 16603
  neuraminidase__InfluenzaA__ACN33203

SEQ ID NO: 16637 - protein, 469 aa, Artificial Sequence
  neuraminidase__InfluenzaA__ACN33214
MNPNQKIITIGSVSLTISTICFFMQIAILITTVTLHFKQYEFNSPPNNQVMLCEPTIIERNITETVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16638 - protein, 470 aa, Artificial Sequence; identical to SEQ ID NO: 16071
  neuraminidase__InfluenzaA__ACN42984

SEQ ID NO: 16639 - protein, 470 aa, Artificial Sequence; identical to SEQ ID NO: 16071
  neuraminidase__InfluenzaA__ACN42995

SEQ ID NO: 16640 - protein, 469 aa, Artificial Sequence
  neuraminidase__InfluenzaA__ACN43006
MNPNQKIITIGSVSLTISTICFFMQIAILITTVTLHFKQYEFNSPPNNRVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16641 - protein, 469 aa, Artificial Sequence; identical to SEQ ID NO: 16603
  neuraminidase__InfluenzaA__ACN43017

SEQ ID NO: 16642 - protein, 469 aa, Artificial Sequence; identical to SEQ ID NO: 16599
  neuraminidase__InfluenzaA__ACN43028

SEQ ID NO: 16643 - protein, 469 aa, Artificial Sequence
  neuraminidase__InfluenzaA__ACN43039
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLETKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16644 - protein, 469 aa, Artificial Sequence; identical to SEQ ID NO: 16512
  neuraminidase__InfluenzaA__ACN43050

SEQ ID NO: 16645 - protein, 469 aa, Artificial Sequence; identical to SEQ ID NO: 16599
  neuraminidase__InfluenzaA__ACN43061

SEQ ID NO: 16646 - protein, 469 aa, Artificial Sequence
  neuraminidase__InfluenzaA__ACN43072
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSVVVFCGTSGTYGTGSWPDGADINLMPI

SEQ ID NO: 16647 - protein, 469 aa, Artificial Sequence
  neuraminidase__InfluenzaA__ACN43083
MNPNQKIITIGSVSLTISTICFFMQIAILITTVTLHFKQYEFNSSPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSNEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16648 - protein, 469 aa, Artificial Sequence; identical to SEQ ID NO: 14327
  neuraminidase__InfluenzaA__ACN50231

SEQ ID NO: 16649 - protein, 469 aa, Artificial Sequence
  neuraminidase__InfluenzaA__ACN50233
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVLTDGSASGKADTKILFIEEGKIVHTSKLSGSAQHVEECSCYPRYPGVRCVCRDNWKGSNRPIVDINIKDYSIVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16650 - protein, 469 aa, Artificial Sequence
  neuraminidase__InfluenzaA__ACN50245
MNPNQKIITIGSVSLTISTICFFMQIAILITTVTLHFKQYEFNSPPNNQVVLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGDRSGYSGIFSVEGKSCINRCFYVELIRGRKEETEVLWTSNSIVVFCGTSGTYGTGSWPDGADINLMPI

SEQ ID NO: 16651 - protein, 470 aa, Artificial Sequence
  neuraminidase__InfluenzaA__ACN72609
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYKIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16652 - protein, 469 aa, Artificial Sequence
  neuraminidase__InfluenzaA__ACN72621
MNPNQKIIIISSICMTNGIASLILQIGNIISIWISHSIQTGNQNQTETCNQSVIIYENNTWVNQTYVNISNNNFVAEQTVVPVKLVGSSPLCPVSGWAIYSKDNSVRIGSKGDVFVIREPFISCSHLECRTFFLTQGALLNDKHSNGTVKDRSPYRTLMSCPIGEVPSPYNSRFESVAWSASACHDGSSWLTIGISGPDNGAVAVLKYNDIITDTIKSWKNNILRTQESECACLNGSCFTVMTDGPSNGQASYKIFKIEKGKVVKSVELNAPNYHYEECSCYPDSGEIICVCRDNWHGSNRPWVSFNQNLEYQIGYICSGVLGDNPRPNDRTGNCGPVSSHGANGVKGFSFKYGDGIWIGRTKSTSSRSGFEMIWDPNGWTGTDNNFSVKQDIVGITDWTGYSGSFVQHPELTGLDCIRPCFWVELIRGRPKENTIWTSGSSISFCGVNSDTVGWSWPDGAELPFTIDK

SEQ ID NO: 16653 - protein, 469 aa, Artificial Sequence; identical to SEQ ID NO: 16512
  neuraminidase__InfluenzaA__ACN76503

SEQ ID NO: 16654 - protein, 469 aa, Artificial Sequence
  neuraminidase__InfluenzaA__ACO36345
MNPNQKIITIGSVSLTISTICFFMQIAILITTVTLHFKQYEFNSSPNNQVMQCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16655 - protein, 469 aa, Artificial Sequence; identical to SEQ ID NO: 14980
  neuraminidase__InfluenzaA__ACO36356

SEQ ID NO: 16656 - protein, 469 aa, Artificial Sequence
  neuraminidase__InfluenzaA__ACO36367
MNPNQKIITIGSVSLIISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTFGTGSWPDGADINLMPI

SEQ ID NO: 16657 - protein, 470 aa, Artificial Sequence; identical to SEQ ID NO: 16632
  neuraminidase__InfluenzaA__ACO36400

SEQ ID NO: 16658 - protein, 469 aa, Artificial Sequence
  neuraminidase__InfluenzaA__ACO36411
MNPNQKIITIGSVSLTISTIGFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRGRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16659 - protein, 469 aa, Artificial Sequence
  neuraminidase__InfluenzaA__ACO36422
MNPNQKIITIGSVSLIISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRGRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16660 - protein, 469 aa, Artificial Sequence; identical to SEQ ID NO: 16416
  neuraminidase__InfluenzaA__ACO36433

SEQ ID NO: 16661 - protein, 469 aa, Artificial Sequence
  neuraminidase__InfluenzaA__ACO36444
MNPNQKIITIGSVSLTIATICFLMQIAILVTTVTLHFKQHECNSPPNNQVMLCEPTIIERNITEIVYLTNTTIEKEKCPKLAEYRNWSKPQCNITGFAPFSKDNSIRLSAGGDIWVTREPYVSCDPDKCYQFALGQGTTLNNGHSNNTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASEKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 16662 - protein, 469 aa, Artificial Sequence
  neuraminidase__InfluenzaA__ACO36466
MNPNQKIITIGSVSLTISTICFFMQIAILITTVTLHFKQYEFNSPPNNQVMLCEPTIIERNITEIAYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSVVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRNQETEVLWTSNSIVVFCGTSGTYGTGSWPDGADINLMPI

SEQ ID NO: 16663 - protein, 469 aa, Artificial Sequence
  neuraminidase__InfluenzaA__ACO36477
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKNILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 16664 - protein, 469 aa, Artificial Sequence
  neuraminidase__InfluenzaA__ACO36499
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSVVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRNQETEVLWTSNSIVVFCGTSGTYGTGSWPDGADINLMPI

SEQ ID NO: 16665 - protein, 469 aa, Artificial Sequence; identical to SEQ ID NO: 14327
  neuraminidase__InfluenzaA__ACO36510

SEQ ID NO: 16666 - protein, 469 aa, Artificial Sequence; identical to SEQ ID NO: 14327
  neuraminidase__InfluenzaA__ACO36543

SEQ ID NO: 16667 - protein, 469 aa, Artificial Sequence; identical to SEQ ID NO: 14327
  neuraminidase__InfluenzaA__ACO36554

SEQ ID NO: 16668 - protein, 469 aa, Artificial Sequence; identical to SEQ ID NO: 14327
  neuraminidase__InfluenzaA__ACO36565

SEQ ID NO: 16669 - protein, 469 aa, Artificial Sequence
  neuraminidase__InfluenzaA__ACO36576
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVGRGNRSGYSGIFSVEGKSCINRCFYVELIRGRKEETEVLWTSNSIVVFCGTSGTYGTGSWPDGADINLMPI

SEQ ID NO: 16670 - protein, 469 aa, Artificial Sequence; identical to SEQ ID NO: 14327
  neuraminidase__InfluenzaA__ACO36587

SEQ ID NO: 16671 - protein, 469 aa, Artificial Sequence; identical to SEQ ID NO: 14712
  neuraminidase__InfluenzaA__ACO36609

SEQ ID NO: 16672 - protein, 469 aa, Artificial Sequence
  neuraminidase__InfluenzaA__ACO36620
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQVNRQVIVDRGNRSGYSGIFSVEGKSCINRCFYVELIRGRKEETEVLWTSNSIVVFCGTSGTYGTGSWPDGADINLMPI

SEQ ID NO: 16673 - protein, 469 aa, Artificial Sequence; identical to SEQ ID NO: 14712
  neuraminidase__InfluenzaA__ACO36631

SEQ ID NO: 16674 - protein, 469 aa, Artificial Sequence; identical to SEQ ID NO: 14712
  neuraminidase__InfluenzaA__ACO36653

SEQ ID NO: 16675 - protein, 469 aa, Artificial Sequence
  neuraminidase__InfluenzaA__ACO36675
MNPNQKIITIGSVSLTISTICLFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16676 - protein, 469 aa, Artificial Sequence
  neuraminidase__InfluenzaA__ACO36686
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDHDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16677 - protein, 469 aa, Artificial Sequence
  neuraminidase__InfluenzaA__ACO37125
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGMLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16678 - protein, 469 aa, Artificial Sequence
  neuraminidase__InfluenzaA__ACO94511
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSNCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16679 - protein, 469 aa, Artificial Sequence; identical to SEQ ID NO: 16512
  neuraminidase__InfluenzaA__ACO94512

SEQ ID NO: 16680 - protein, 469 aa, Artificial Sequence; identical to SEQ ID NO: 16599
  neuraminidase__InfluenzaA__ACO94513

SEQ ID NO: 16681 - protein, 469 aa, Artificial Sequence
  neuraminidase__InfluenzaA__ACO94675
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKNHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16682 - protein, 469 aa, Artificial Sequence
  neuraminidase__InfluenzaA__ACO94686
MNPNQKIITIGSVSLTISTICFFMQIAILITTVTLHFKQYEFNSPPNNQVMLCEPTTIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGAEINLMPI

SEQ ID NO: 16683 - protein, 469 aa, Artificial Sequence; identical to SEQ ID NO: 16599
  neuraminidase__InfluenzaA__ACO94697

SEQ ID NO: 16684 - protein, 470 aa, Artificial Sequence; identical to SEQ ID NO: 16632
  neuraminidase__InfluenzaA__ACO94708

SEQ ID NO: 16685 - protein, 469 aa, Artificial Sequence
  neuraminidase__InfluenzaA__ACO94719
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGAEINLMPI

SEQ ID NO: 16686 - protein, 469 aa, Artificial Sequence
  neuraminidase__InfluenzaA__ACO94741
MNPNQKIITIGSVSLTISTICFFMQIAILITTVTLHFKQYEFNSSPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVESKSCINRCFYVELIRGRKEETEVLWTSNSIVVFCGTSGTYGTGSWPDGADINLMPI

SEQ ID NO: 16687 - protein, 469 aa, Artificial Sequence; identical to SEQ ID NO: 16603
  neuraminidase__InfluenzaA__ACO94763

SEQ ID NO: 16688 - protein, 469 aa, Artificial Sequence
  neuraminidase__InfluenzaA__ACO94774
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGRAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16689 - protein, 469 aa, Artificial Sequence
  neuraminidase__InfluenzaA__ACO94785
MNPNQKIITIGSVSLTISTICFFMQIAILITTVTLHFKQYEFNSPPNNQVMLCKPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16690 - protein, 469 aa, Artificial Sequence; identical to SEQ ID NO: 16599
  neuraminidase__InfluenzaA__ACO94796

SEQ ID NO: 16691 - protein, 470 aa, Artificial Sequence
  neuraminidase__InfluenzaA__ACO94807
MNPNQKIITIGSISIAIGIISLILQIGNIISIWASHSIQTGSQNHTGICNQRIITYENSTWVNNTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGTASYKIFKIEKGKVTKTIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSGTANWSWPDGAELPFTIDK

SEQ ID NO: 16692 - protein, 469 aa, Artificial Sequence; identical to SEQ ID NO: 16414
  neuraminidase__InfluenzaA__ACO94818

SEQ ID NO: 16693 - protein, 454 aa, Artificial Sequence; identical to SEQ ID NO: 15719
  neuraminidase__InfluenzaA__ACO94829

SEQ ID NO: 16694 - protein, 454 aa, Artificial Sequence; identical to SEQ ID NO: 15719
  neuraminidase__InfluenzaA__ACO94840

SEQ ID NO: 16695 - protein, 469 aa, Artificial Sequence
  neuraminidase__InfluenzaA__ACO94851
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDIVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16696 - protein, 470 aa, Artificial Sequence; identical to SEQ ID NO: 16632
  neuraminidase__InfluenzaA__ACO94873

SEQ ID NO: 16697 - protein, 469 aa, Artificial Sequence
  neuraminidase__InfluenzaA__ACO94884
MNPNQKIITIGSVSLTIATICFLMQIAILVTTVTLHFKQHECNSPPNNQVMLCEPTIIERNITEIVYLTNTTIEKEMCPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 16698 - protein, 469 aa, Artificial Sequence; identical to SEQ ID NO: 14714
  neuraminidase__InfluenzaA__ACO94906

SEQ ID NO: 16699 - protein, 469 aa, Artificial Sequence; identical to SEQ ID NO: 14145
  neuraminidase__InfluenzaA__ACO94917

SEQ ID NO: 16700 - protein, 469 aa, Artificial Sequence; identical to SEQ ID NO: 14714
  neuraminidase__InfluenzaA__ACO94928

SEQ ID NO: 16701 - protein, 469 aa, Artificial Sequence; identical to SEQ ID NO: 14145
  neuraminidase__InfluenzaA__ACO94939

SEQ ID NO: 16702 - protein, 469 aa, Artificial Sequence
  neuraminidase__InfluenzaA__ACO94950
MNPNQKIITIGSVSLTISTICFLMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16703 - protein, 469 aa, Artificial Sequence
  neuraminidase__InfluenzaA__ACO94961
MNPNQKIITIGSVSLTISTICFFMQIAILITTVTLHFKQYEFNSPPNNQVMLCEPTIIERNITEIVYLTNTTIEKELCPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16704 - protein, 469 aa, Artificial Sequence
  neuraminidase__InfluenzaA__ACO94972
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSVVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRNQETEVLWTSNSIVVFCGTSGTYGTGSWPDGADINLMPI

SEQ ID NO: 16705 - protein, 469 aa, Artificial Sequence
  neuraminidase__InfluenzaA__ACO95156
MNPNQKIITIGSVSLTISTICFFMQIAILITTVTLHFKQYEFNSPPNNQVMLCEPTIIERNITEIVYLTNTTIEKETCPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCITGDDKNATASFIYNGRLVDSVVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRNQETEVLWTSNSIVVFCGTSGTYGTGSWPDGADINLMPI

SEQ ID NO: 16706 - protein, 469 aa, Artificial Sequence; identical to SEQ ID NO: 14327
  neuraminidase__InfluenzaA__ACO95174

SEQ ID NO: 16707 - protein, 469 aa, Artificial Sequence; identical to SEQ ID NO: 14327
  neuraminidase__InfluenzaA__ACO95185

SEQ ID NO: 16708 - protein, 469 aa, Artificial Sequence
  neuraminidase__InfluenzaA__ACO95196
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTIHDRTPYRTLLMNELGVPFHLGTKQVCIAWSSSSCHDGKAWLHVCVTGDDKNATASFIYNGRLVDSVVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRNQETEVLWTSNSIVVFCGTSGTYGTGSWPDGADINLMPI

SEQ ID NO: 16709 - protein, 469 aa, Artificial Sequence; identical to SEQ ID NO: 14327
  neuraminidase__InfluenzaA__ACO95207

SEQ ID NO: 16710 - protein, 469 aa, Artificial Sequence; identical to SEQ ID NO: 14327
  neuraminidase__InfluenzaA__ACO95218

SEQ ID NO: 16711 - protein, 469 aa, Artificial Sequence; identical to SEQ ID NO: 14330
  neuraminidase__InfluenzaA__ACO95229

SEQ ID NO: 16712 - protein, 469 aa, Artificial Sequence; identical to SEQ ID NO: 14712
  neuraminidase__InfluenzaA__ACO95240

SEQ ID NO: 16713 - protein, 469 aa, Artificial Sequence; identical to SEQ ID NO: 14573
  neuraminidase__InfluenzaA__ACO95262

SEQ ID NO: 16714 - protein, 469 aa, Artificial Sequence; identical to SEQ ID NO: 16511
  neuraminidase__InfluenzaA__ACO95273

SEQ ID NO: 16715 - protein, 469 aa, Artificial Sequence; identical to SEQ ID NO: 16603
  neuraminidase__InfluenzaA__ACO95306

SEQ ID NO: 16716 - protein, 470 aa, Artificial Sequence
  neuraminidase__InfluenzaA__ACO95385
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSDKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16717 - protein, 470 aa, Artificial Sequence; identical to SEQ ID NO: 16632
  neuraminidase__InfluenzaA__ACO95407

SEQ ID NO: 16718 - protein, 470 aa, Artificial Sequence; identical to SEQ ID NO: 16632
  neuraminidase__InfluenzaA__ACO95418

SEQ ID NO: 16719 - protein, 469 aa, Artificial Sequence; identical to SEQ ID NO: 14145
  neuraminidase__InfluenzaA__ACO95429

SEQ ID NO: 16720 - protein, 469 aa, Artificial Sequence; identical to SEQ ID NO: 14714
  neuraminidase__InfluenzaA__ACO95440

SEQ ID NO: 16721 - protein, 469 aa, Artificial Sequence
  neuraminidase__InfluenzaA__ACO95462
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMLI

SEQ ID NO: 16722 - protein, 469 aa, Artificial Sequence; identical to SEQ ID NO: 14712
  neuraminidase__InfluenzaA__ACO95484

SEQ ID NO: 16723 - protein, 469 aa, Artificial Sequence; identical to SEQ ID NO: 14712
  neuraminidase__InfluenzaA__ACO95495

SEQ ID NO: 16724 - protein, 469 aa, Artificial Sequence; identical to SEQ ID NO: 14712
  neuraminidase__InfluenzaA__ACO95506

SEQ ID NO: 16725 - protein, 469 aa, Artificial Sequence
  neuraminidase__InfluenzaA__ACO95517
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16726 - protein, 469 aa, Artificial Sequence
  neuraminidase__InfluenzaA__ACO95539
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKANTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16727 - protein, 470 aa, Artificial Sequence
  neuraminidase__InfluenzaA__ACP20223
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAVTDWSGYSGSFVQHPELTGLDCIRPCFWVELVRGLPRENTTIWTSGSSISFCGVNSDTANWSWPDGAELPFTIDK

SEQ ID NO: 16728 - protein, 469 aa, Artificial Sequence
  neuraminidase__InfluenzaA__ACP41952
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16729 - protein, 469 aa, Artificial Sequence; identical to SEQ ID NO: 16728
  neuraminidase__InfluenzaA__ACP44158

SEQ ID NO: 16730 - protein, 470 aa, Artificial Sequence
  neuraminidase__InfluenzaA__ACP44195
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSDKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLNCIRPCFWVELVRGLPRENTTIWTSGSSISFCGVNSDTANWSWPDGAELPFTIDK

SEQ ID NO: 16731 - protein, 470 aa, Artificial Sequence; identical to SEQ ID NO: 16632
  neuraminidase__InfluenzaA__ACP44217

SEQ ID NO: 16732 - protein, 470 aa, Artificial Sequence; identical to SEQ ID NO: 16632
  neuraminidase__InfluenzaA__ACP44228

SEQ ID NO: 16733 - protein, 469 aa, Artificial Sequence; identical to SEQ ID NO: 14714
  neuraminidase__InfluenzaA__ACP44239

SEQ ID NO: 16734 - protein, 469 aa, Artificial Sequence
  neuraminidase__InfluenzaA__ACP44250
MNPNQKIITIGSVSLTISTICFFMQIAILMTTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16735 - protein, 469 aa, Artificial Sequence
  neuraminidase__InfluenzaA__ACP44261
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNMHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16736 - protein, 469 aa, Artificial Sequence
  neuraminidase__InfluenzaA__ACP44272
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVIMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16737 - protein, 469 aa, Artificial Sequence; identical to SEQ ID NO: 16728
  neuraminidase__InfluenzaA__ACQ55360

SEQ ID NO: 16738 - protein, 469 aa, Artificial Sequence
  neuraminidase__InfluenzaA__ACQ63236
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16739 - protein, 469 aa, Artificial Sequence; identical to SEQ ID NO: 16738
  neuraminidase__InfluenzaA__ACQ63242

SEQ ID NO: 16740 - protein, 469 aa, Artificial Sequence; identical to SEQ ID NO: 16738
  neuraminidase__InfluenzaA__ACQ63253

SEQ ID NO: 16741 - protein, 469 aa, Artificial Sequence; identical to SEQ ID NO: 16738
  neuraminidase__InfluenzaA__ACQ63262

SEQ ID NO: 16742 - protein, 469 aa, Artificial Sequence
  neuraminidase__InfluenzaA__ACQ65694
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKDILRTQESECVCINGTCTVVMTDGSASGKADTKILFIEEGKIVHTSTLSGSAQHVEECSCYPRYPGVRCVCRDNWRGSNRPIVDINMKDYSIVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16743 - protein, 469 aa, Artificial Sequence
  neuraminidase__InfluenzaA__ACQ65705
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWRGSNRPIVDINMKDYSIVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16744 - protein, 469 aa, Artificial Sequence; identical to SEQ ID NO: 16512
  neuraminidase__InfluenzaA__ACQ65716

SEQ ID NO: 16745 - protein, 469 aa, Artificial Sequence; identical to SEQ ID NO: 16512
  neuraminidase__InfluenzaA__ACQ65727

SEQ ID NO: 16746 - protein, 469 aa, Artificial Sequence; identical to SEQ ID NO: 16599
  neuraminidase__InfluenzaA__ACQ65739

SEQ ID NO: 16747 - protein, 469 aa, Artificial Sequence
  neuraminidase__InfluenzaA__ACQ65750
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16748 - protein, 470 aa, Artificial Sequence; identical to SEQ ID NO: 16632
  neuraminidase__InfluenzaA__ACQ65761

SEQ ID NO: 16749 - protein, 469 aa, Artificial Sequence; identical to SEQ ID NO: 16728
  neuraminidase__InfluenzaA__ACQ73394

SEQ ID NO: 16750 - protein, 469 aa, Artificial Sequence; identical to SEQ ID NO: 16728
  neuraminidase__InfluenzaA__ACQ73395

SEQ ID NO: 16751 - protein, 469 aa, Artificial Sequence; identical to SEQ ID NO: 16738
  neuraminidase__InfluenzaA__ACQ73396

SEQ ID NO: 16752 - protein, 469 aa, Artificial Sequence; identical to SEQ ID NO: 16738
  neuraminidase__InfluenzaA__ACQ76291

SEQ ID NO: 16753 - protein, 469 aa, Artificial Sequence
  neuraminidase__InfluenzaA__ACQ76298
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16754 - protein, 469 aa, Artificial Sequence; identical to SEQ ID NO: 16738
  neuraminidase__InfluenzaA__ACQ76308

SEQ ID NO: 16755 - protein, 469 aa, Artificial Sequence; identical to SEQ ID NO: 16738
  neuraminidase__InfluenzaA__ACQ76316

SEQ ID NO: 16756 - protein, 469 aa, Artificial Sequence; identical to SEQ ID NO: 16728
  neuraminidase__InfluenzaA__ACQ76322

SEQ ID NO: 16757 - protein, 469 aa, Artificial Sequence; identical to SEQ ID NO: 16728
  neuraminidase__InfluenzaA__ACQ76328

SEQ ID NO: 16758 - protein, 469 aa, Artificial Sequence; identical to SEQ ID NO: 16728
  neuraminidase__InfluenzaA__ACQ76335

SEQ ID NO: 16759 - protein, 469 aa, Artificial Sequence; identical to SEQ ID NO: 16728
  neuraminidase__InfluenzaA__ACQ76342

SEQ ID NO: 16760 - protein, 469 aa, Artificial Sequence; identical to SEQ ID NO: 16728
  neuraminidase__InfluenzaA__ACQ76351

SEQ ID NO: 16761 - protein, 469 aa, Artificial Sequence; identical to SEQ ID NO: 16728
  neuraminidase__InfluenzaA__ACQ76359

SEQ ID NO: 16762 - protein, 469 aa, Artificial Sequence; identical to SEQ ID NO: 16738
  neuraminidase__InfluenzaA__ACQ76364

SEQ ID NO: 16763 - protein, 469 aa, Artificial Sequence; identical to SEQ ID NO: 16738
  neuraminidase__InfluenzaA__ACQ76367

SEQ ID NO: 16764 - protein, 469 aa, Artificial Sequence
  neuraminidase__InfluenzaA__ACQ76379
MNPNQKIITIGSVCMTIGMANLILQIGNIISIWISHSIQLGNQNQIETCNQSVITYKNNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16765 - protein, 469 aa, Artificial Sequence; identical to SEQ ID NO: 16738
  neuraminidase__InfluenzaA__ACQ76385

SEQ ID NO: 16766 - protein, 469 aa, Artificial Sequence; identical to SEQ ID NO: 16738
  neuraminidase__InfluenzaA__ACQ76388

SEQ ID NO: 16767 - protein, 469 aa, Artificial Sequence; identical to SEQ ID NO: 16738
  neuraminidase__InfluenzaA__ACQ76403

SEQ ID NO: 16768 - protein, 469 aa, Artificial Sequence
  neuraminidase__InfluenzaA__ACQ76407
MNPNQKIITIGSVCMTIGMANLILQIGNIISIWISHSIQLGNQNQIETCNQSVITYENNTWVNQTYVNISNTNFAAGQSVVSVKLAGNSSLCPVGGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16769 - protein, 469 aa, Artificial Sequence
  neuraminidase__InfluenzaA__ACQ77603
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSPLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 16770 - protein, 469 aa, Artificial Sequence; identical to SEQ ID NO: 16728
  neuraminidase__InfluenzaA__ACQ83309

SEQ ID NO: 16771 - protein, 469 aa, Artificial Sequence; identical to SEQ ID NO: 16728
  neuraminidase__InfluenzaA__ACQ84460

SEQ ID NO: 16772 - protein, 469 aa, Artificial Sequence; identical to SEQ ID NO: 16728
  neuraminidase__InfluenzaA__ACQ84470

SEQ ID NO: 16773 - protein, 469 aa, Artificial Sequence
  neuraminidase__InfluenzaA__ACQ84480
MNTNQRIITIGTVCLIVGIVSLLLQIGNIVSLWISHSIKTGEKNHSEICNQNIITYENKTWVNQTYVNISNTNIADGQGVTSIILAGNSSLCPISGWAIYSKDNSIRIGSKGDIFVIREPFISCSHLECRTFFLTQGALLNDRHSNGTVKDRSPYRTLMSCPTGEAPSPYNSRFESVAWSASACHDGMGWLTIGISGPDNGAVAVLKYNGIITDTIKSWRNKILRTQESECVCINGSCFTIMTDGPSNGQASYKIFKMEKGKIIKSVELDAPNYHYEECSCYPDTGKVVCVCRDNWHASNRPWVSFDQNLDYQIGYICSGVFGDNPRSNDGKGNCGPVLSNGANGVKGFSFRYGNGVWIGRTKSISSRSGFEMIWDPNGWTETDSSFSIKQDIIALTDWSGYSGSFVQHPELTGMNCIRPCFWVELIRGQPKESTIWTSGSSISFCGVDSETASWSWPDGADLPFTIDK

SEQ ID NO: 16774 - protein, 469 aa, Artificial Sequence
  neuraminidase__InfluenzaA__ACQ89891
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICRGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16775 - protein, 469 aa, Artificial Sequence; identical to SEQ ID NO: 16728
  neuraminidase__InfluenzaA__ACQ89918

SEQ ID NO: 16776 - protein, 469 aa, Artificial Sequence
  neuraminidase__InfluenzaA__ACQ89919
MNPNQKIITIGSVCMTIGMANLILQIGNIISIWISRSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16777 - protein, 469 aa, Artificial Sequence; identical to SEQ ID NO: 16738
  neuraminidase__InfluenzaA__ACQ89920

SEQ ID NO: 16778 - protein, 469 aa, Artificial Sequence; identical to SEQ ID NO: 16738
  neuraminidase__InfluenzaA__ACQ89921

SEQ ID NO: 16779 - protein, 469 aa, Artificial Sequence; identical to SEQ ID NO: 16728
  neuraminidase__InfluenzaA__ACQ89922

SEQ ID NO: 16780 - protein, 469 aa, Artificial Sequence; identical to SEQ ID NO: 16738
  neuraminidase__InfluenzaA__ACQ89923

SEQ ID NO: 16781 - protein, 469 aa, Artificial Sequence; identical to SEQ ID NO: 16728
  neuraminidase__InfluenzaA__ACQ99623

SEQ ID NO: 16782 - protein, 469 aa, Artificial Sequence; identical to SEQ ID NO: 16738
  neuraminidase__InfluenzaA__ACQ99624

SEQ ID NO: 16783 - protein, 469 aa, Artificial Sequence; identical to SEQ ID NO: 16728
  neuraminidase__InfluenzaA__ACQ99626

SEQ ID NO: 16784 - protein, 469 aa, Artificial Sequence; identical to SEQ ID NO: 16728
  neuraminidase__InfluenzaA__ACQ99627

SEQ ID NO: 16785 - protein, 469 aa, Artificial Sequence; identical to SEQ ID NO: 16728
  neuraminidase__InfluenzaA__ACQ99628

SEQ ID NO: 16786 - protein, 469 aa, Artificial Sequence; identical to SEQ ID NO: 16728
  neuraminidase__InfluenzaA__ACQ99629

SEQ ID NO: 16787 - protein, 469 aa, Artificial Sequence; identical to SEQ ID NO: 16728
  neuraminidase__InfluenzaA__ACQ99630

SEQ ID NO: 16788 - protein, 469 aa, Artificial Sequence; identical to SEQ ID NO: 16738
  neuraminidase__InfluenzaA__ACQ99632

SEQ ID NO: 16789 - protein, 469 aa, Artificial Sequence; identical to SEQ ID NO: 16738
  neuraminidase__InfluenzaA__ACQ99633

SEQ ID NO: 16790 - protein, 469 aa, Artificial Sequence; identical to SEQ ID NO: 16728
  neuraminidase__InfluenzaA__ACQ99635

SEQ ID NO: 16791 - protein, 469 aa, Artificial Sequence; identical to SEQ ID NO: 16728
  neuraminidase__InfluenzaA__ACQ99636

SEQ ID NO: 16792 - protein, 469 aa, Artificial Sequence
  neuraminidase__InfluenzaA__ACQ99684
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDEQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16793 - protein, 469 aa, Artificial Sequence
  neuraminidase__InfluenzaA__ACQ99824
MNTNQRIITIGTICLIVGIISLLLQIGNIILLWMSHSIQTGEKSHPKVCNQSVITYENNTWVNQTYVNISNTNIAAGQGVTPIILAGNSSLCPISGWAIYSKDNSIRIGSKGDIFVMREPFISCSHLECRTFFLTQGALLNDRHSNGTVKDRSPYRTLMSCPIGEAPSPYNSRFESVAWSASACHDGMGWLTIGISGPDNGAVAVLKYNGIITDTIKSWRNKILRTQESECVCINGSCFTIMTDGPSNGQASYKLFKMEKGKIIKSIELDAPNYHYEECSCYPDTGKVVCVCRDNWHASNRPWVSFDQNLDYQIGYICSGVFGDNPRSNDGKGNCGPVLSNGANGVKGFSFRYGNGVWIGRTKSISSRSGFEMIWDPNGWTETDSSFSMKQDIIALTDWSGYSGSFVQHPELTGMNCIRPCFWVELIRGQPKESTIWTSGSSISFCGVNSGTASWSWPDGADLPFTIDK

SEQ ID NO: 16794 - protein, 469 aa, Artificial Sequence; identical to SEQ ID NO: 16738
  neuraminidase__InfluenzaA__ACR01015

SEQ ID NO: 16795 - protein, 469 aa, Artificial Sequence; identical to SEQ ID NO: 16738
  neuraminidase__InfluenzaA__ACR08422

SEQ ID NO: 16796 - protein, 469 aa, Artificial Sequence; identical to SEQ ID NO: 16738
  neuraminidase__InfluenzaA__ACR08432

SEQ ID NO: 16797 - protein, 469 aa, Artificial Sequence; identical to SEQ ID NO: 16738
  neuraminidase__InfluenzaA__ACR08442

SEQ ID NO: 16798 - protein, 469 aa, Artificial Sequence; identical to SEQ ID NO: 16738
  neuraminidase__InfluenzaA__ACR08452

SEQ ID NO: 16799 - protein, 469 aa, Artificial Sequence
  neuraminidase__InfluenzaA__ACR08462
MSPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16800 - protein, 469 aa, Artificial Sequence
  neuraminidase__InfluenzaA__ACR08565
MNPNQKIITIGSVCMTIGMANLILQIGNIISIWISHSIQLGNQNQIETCNQSVITYENNTWVNQTYVNISNTNFAAGQSVVPVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16801 - protein, 469 aa, Artificial Sequence; identical to SEQ ID NO: 16728
  neuraminidase__InfluenzaA__ACR08566

SEQ ID NO: 16802 - protein, 469 aa, Artificial Sequence; identical to SEQ ID NO: 16738
  neuraminidase__InfluenzaA__ACR08567

SEQ ID NO: 16803 - protein, 469 aa, Artificial Sequence; identical to SEQ ID NO: 16728
  neuraminidase__InfluenzaA__ACR08568

SEQ ID NO: 16804 - protein, 469 aa, Artificial Sequence; identical to SEQ ID NO: 16728
  neuraminidase__InfluenzaA__ACR08569

SEQ ID NO: 16805 - protein, 469 aa, Artificial Sequence; identical to SEQ ID NO: 16738
  neuraminidase__InfluenzaA__ACR08570

SEQ ID NO: 16806 - protein, 469 aa, Artificial Sequence; identical to SEQ ID NO: 16728
  neuraminidase__InfluenzaA__ACR08571

SEQ ID NO: 16807 - protein, 469 aa, Artificial Sequence; identical to SEQ ID NO: 16728
  neuraminidase__InfluenzaA__ACR08572

SEQ ID NO: 16808 - protein, 469 aa, Artificial Sequence; identical to SEQ ID NO: 16728
  neuraminidase__InfluenzaA__ACR08573

SEQ ID NO: 16809 - protein, 469 aa, Artificial Sequence; identical to SEQ ID NO: 16728
  neuraminidase__InfluenzaA__ACR08574

SEQ ID NO: 16810 - protein, 469 aa, Artificial Sequence; identical to SEQ ID NO: 16738
  neuraminidase__InfluenzaA__ACR08576

SEQ ID NO: 16811 - protein, 469 aa, Artificial Sequence; identical to SEQ ID NO: 16728
  neuraminidase__InfluenzaA__ACR08577

SEQ ID NO: 16812 - protein, 469 aa, Artificial Sequence; identical to SEQ ID NO: 16728
  neuraminidase__InfluenzaA__ACR09378

SEQ ID NO: 16813 - protein, 469 aa, Artificial Sequence; identical to SEQ ID NO: 16728
  neuraminidase__InfluenzaA__ACR09379

SEQ ID NO: 16814 - protein, 469 aa, Artificial Sequence; identical to SEQ ID NO: 16738
  neuraminidase__InfluenzaA__ACR09380

SEQ ID NO: 16815 - protein, 469 aa, Artificial Sequence; identical to SEQ ID NO: 16728
  neuraminidase__InfluenzaA__ACR09381

SEQ ID NO: 16816 - protein, 469 aa, Artificial Sequence; identical to SEQ ID NO: 16728
  neuraminidase__InfluenzaA__ACR09382

SEQ ID NO: 16817 - protein, 469 aa, Artificial Sequence; identical to SEQ ID NO: 16738
  neuraminidase__InfluenzaA__ACR09383

SEQ ID NO: 16818 - protein, 469 aa, Artificial Sequence; identical to SEQ ID NO: 16728
  neuraminidase__InfluenzaA__ACR09384

SEQ ID NO: 16819 - protein, 469 aa, Artificial Sequence; identical to SEQ ID NO: 16738
  neuraminidase__InfluenzaA__ACR09385

SEQ ID NO: 16820 - protein, 469 aa, Artificial Sequence; identical to SEQ ID NO: 16728
  neuraminidase__InfluenzaA__ACR09386

SEQ ID NO: 16821 - protein, 469 aa, Artificial Sequence; identical to SEQ ID NO: 16738
  neuraminidase__InfluenzaA__ACR10189

SEQ ID NO: 16822 - protein, 469 aa, Artificial Sequence; identical to SEQ ID NO: 16738
  neuraminidase__InfluenzaA__ACR10226

SEQ ID NO: 16823 - protein, 469 aa, Artificial Sequence; identical to SEQ ID NO: 16728
  neuraminidase__InfluenzaA__ACR10236

SEQ ID NO: 16824 - protein, 469 aa, Artificial Sequence; identical to SEQ ID NO: 16728
  neuraminidase__InfluenzaA__ACR10237

SEQ ID NO: 16825 - protein, 469 aa, Artificial Sequence
  neuraminidase__InfluenzaA__ACR15186
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRHPGVRCVCRDNWRGSNRPIVDINMKDYSIVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16826 - protein, 470 aa, Artificial Sequence; identical to SEQ ID NO: 16632
  neuraminidase__InfluenzaA__ACR15197

SEQ ID NO: 16827 - protein, 469 aa, Artificial Sequence
  neuraminidase__InfluenzaA__ACR15208
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDKGNRSGYSGIFSVEGKSCINRCFYVELIRGRKEETEVLWTSNSIVVFCGTSGTYGTGSWPDGADINLMPI

SEQ ID NO: 16828 - protein, 469 aa, Artificial Sequence
  neuraminidase__InfluenzaA__ACR15230
MDPNQKIITIGSVSLTISAICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSVVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSNSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRNQETEVLWTSNSIVVFCGTSGTYGTGSWPDGADINLMPI

SEQ ID NO: 16829 - protein, 470 aa, Artificial Sequence; identical to SEQ ID NO: 16632
  neuraminidase__InfluenzaA__ACR15241

SEQ ID NO: 16830 - protein, 469 aa, Artificial Sequence; identical to SEQ ID NO: 15884
  neuraminidase__InfluenzaA__ACR15252

SEQ ID NO: 16831 - protein, 470 aa, Artificial Sequence
  neuraminidase__InfluenzaA__ACR15263
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWSSGSSISFCGVNSDTANWSWPDGAELPFTIDK

SEQ ID NO: 16832 - protein, 470 aa, Artificial Sequence; identical to SEQ ID NO: 16632
  neuraminidase__InfluenzaA__ACR15274

SEQ ID NO: 16833 - protein, 470 aa, Artificial Sequence
  neuraminidase__InfluenzaA__ACR15307
MNPNQKIITIGSISITIGIISLMLQIGNIISIWASHSIQTGSQNHTGICNQRIITYENNTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16834 - protein, 470 aa, Artificial Sequence
  neuraminidase__InfluenzaA__ACR15318
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKRQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 16835 - protein, 470 aa, Artificial Sequence
  neuraminidase__InfluenzaA__ACR15329
MNPNQKIITIGSISIAIGIISLMLQIGNIISIWASHSIQTRSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 16836 - protein, 470 aa, Artificial Sequence; identical to SEQ ID NO: 16632
  neuraminidase__InfluenzaA__ACR15340

SEQ ID NO: 16837 - protein, 470 aa, Artificial Sequence; identical to SEQ ID NO: 16632
  neuraminidase__InfluenzaA__ACR15362

SEQ ID NO: 16838 - protein, 470 aa, Artificial Sequence; identical to SEQ ID NO: 16632
  neuraminidase__InfluenzaA__ACR15373

SEQ ID NO: 16839 - protein, 470 aa, Artificial Sequence
  neuraminidase__InfluenzaA__ACR15428
MNPNQKIITIGSISIAIGIISLMLQIGNIISIWASHSIQTGSQNNTGICNQRIITYENSTWVNHTYVNINNTNVVAGEDKTSVTLAGNSSLCSVSGWAIYTKDNSIRIGSKGDVFVIREPFISCSHLECRTFFLTKGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16840 - protein, 470 aa, Artificial Sequence
  neuraminidase__InfluenzaA__ACR15472
MNPNQKIITIGSISIAIGIISLMLQIGNIISIWASHSIQTGSQNNTGICNQRIITYENSTWVNHTYVNINNTNVVAGEDKTPVTLAGNSSLCSISGWAIYTKDNSIRIGSKGDVFVIREPFIACSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEVIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 16841 - protein, 470 aa, Artificial Sequence; identical to SEQ ID NO: 16632
  neuraminidase__InfluenzaA__ACR15483

SEQ ID NO: 16842 - protein, 470 aa, Artificial Sequence; identical to SEQ ID NO: 16632
  neuraminidase__InfluenzaA__ACR15505

SEQ ID NO: 16843 - protein, 470 aa, Artificial Sequence; identical to SEQ ID NO: 16716
  neuraminidase__InfluenzaA__ACR15516

SEQ ID NO: 16844 - protein, 469 aa, Artificial Sequence; identical to SEQ ID NO: 14714
  neuraminidase__InfluenzaA__ACR15527

SEQ ID NO: 16845 - protein, 469 aa, Artificial Sequence
  neuraminidase__InfluenzaA__ACR15538
MIPIQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16846 - protein, 469 aa, Artificial Sequence; identical to SEQ ID NO: 14327
  neuraminidase__InfluenzaA__ACR15549

SEQ ID NO: 16847 - protein, 469 aa, Artificial Sequence; identical to SEQ ID NO: 14712
  neuraminidase__InfluenzaA__ACR15560

SEQ ID NO: 16848 - protein, 469 aa, Artificial Sequence; identical to SEQ ID NO: 14712
  neuraminidase__InfluenzaA__ACR15582

SEQ ID NO: 16849 - protein, 469 aa, Artificial Sequence
  neuraminidase__InfluenzaA__ACR15593
MNPNQKIITIGSVSLTISTICFFMQIAILITTVTLHFKQYEFNSPPNNQVMLCEPTIIERNITEIVYLTNTTIEKEICPKQAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 16850 - protein, 469 aa, Artificial Sequence
  neuraminidase__InfluenzaA__ACR15604
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGDRSGYSGIFSVEGKSCINRCFYVELIRGRKEETEVLWTSNSIVVFCGTSGTYGTGSWPDGADINLMPI

SEQ ID NO: 16851 - protein, 469 aa, Artificial Sequence; identical to SEQ ID NO: 16728
  neuraminidase__InfluenzaA__ACR15618

SEQ ID NO: 16852 - protein, 469 aa, Artificial Sequence; identical to SEQ ID NO: 16728
  neuraminidase__InfluenzaA__ACR18924

SEQ ID NO: 16853 - protein, 469 aa, Artificial Sequence; identical to SEQ ID NO: 16728
  neuraminidase__InfluenzaA__ACR18925

SEQ ID NO: 16854 - protein, 469 aa, Artificial Sequence; identical to SEQ ID NO: 16738
  neuraminidase__InfluenzaA__ACR18926

SEQ ID NO: 16855 - protein, 469 aa, Artificial Sequence; identical to SEQ ID NO: 16738
  neuraminidase__InfluenzaA__ACR18927

SEQ ID NO: 16856 - protein, 469 aa, Artificial Sequence; identical to SEQ ID NO: 16738
  neuraminidase__InfluenzaA__ACR18928

SEQ ID NO: 16857 - protein, 469 aa, Artificial Sequence; identical to SEQ ID NO: 16738
  neuraminidase__InfluenzaA__ACR18929

SEQ ID NO: 16858 - protein, 469 aa, Artificial Sequence; identical to SEQ ID NO: 16738
  neuraminidase__InfluenzaA__ACR18930

SEQ ID NO: 16859 - protein, 469 aa, Artificial Sequence; identical to SEQ ID NO: 16738
  neuraminidase__InfluenzaA__ACR18931

SEQ ID NO: 16860 - protein, 469 aa, Artificial Sequence; identical to SEQ ID NO: 16738
  neuraminidase__InfluenzaA__ACR18933

SEQ ID NO: 16861 - protein, 469 aa, Artificial Sequence; identical to SEQ ID NO: 16728
  neuraminidase__InfluenzaA__ACR18934

SEQ ID NO: 16862 - protein, 469 aa, Artificial Sequence; identical to SEQ ID NO: 16738
  neuraminidase__InfluenzaA__ACR18935

SEQ ID NO: 16863 - protein, 469 aa, Artificial Sequence; identical to SEQ ID NO: 16738
  neuraminidase__InfluenzaA__ACR23301

SEQ ID NO: 16864 - protein, 469 aa, Artificial Sequence; identical to SEQ ID NO: 16738
  neuraminidase__InfluenzaA__ACR32997

SEQ ID NO: 16865 - protein, 469 aa, Artificial Sequence
  neuraminidase__InfluenzaA__ACR33740
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSGTVGWSWPDGAELPFTIDK

SEQ ID NO: 16866 - protein, 469 aa, Artificial Sequence; identical to SEQ ID NO: 16728
  neuraminidase__InfluenzaA__ACR38792

SEQ ID NO: 16867 - protein, 469 aa, Artificial Sequence; identical to SEQ ID NO: 16738
  neuraminidase__InfluenzaA__ACR38793

SEQ ID NO: 16868 - protein, 469 aa, Artificial Sequence; identical to SEQ ID NO: 16738
  neuraminidase__InfluenzaA__ACR38794

SEQ ID NO: 16869 - protein, 469 aa, Artificial Sequence; identical to SEQ ID NO: 16738
  neuraminidase__InfluenzaA__ACR38878

SEQ ID NO: 16870 - protein, 469 aa, Artificial Sequence; identical to SEQ ID NO: 16738
  neuraminidase__InfluenzaA__ACR39357

SEQ ID NO: 16871 - protein, 469 aa, Artificial Sequence; identical to SEQ ID NO: 16738
  neuraminidase__InfluenzaA__ACR39396

SEQ ID NO: 16872 - protein, 469 aa, Artificial Sequence; identical to SEQ ID NO: 16738
  neuraminidase__InfluenzaA__ACR39406

SEQ ID NO: 16873 - protein, 469 aa, Artificial Sequence; identical to SEQ ID NO: 16738
  neuraminidase__InfluenzaA__ACR39416

SEQ ID NO: 16874 - protein, 469 aa, Artificial Sequence; identical to SEQ ID NO: 16738
  neuraminidase__InfluenzaA__ACR39426

SEQ ID NO: 16875 - protein, 469 aa, Artificial Sequence; identical to SEQ ID NO: 16738
  neuraminidase__InfluenzaA__ACR39436

SEQ ID NO: 16876 - protein, 469 aa, Artificial Sequence; identical to SEQ ID NO: 16738
  neuraminidase__InfluenzaA__ACR39446

SEQ ID NO: 16877 - protein, 469 aa, Artificial Sequence; identical to SEQ ID NO: 16738
  neuraminidase__InfluenzaA__ACR39456

SEQ ID NO: 16878 - protein, 469 aa, Artificial Sequence; identical to SEQ ID NO: 16738
  neuraminidase__InfluenzaA__ACR39466

SEQ ID NO: 16879 - protein, 469 aa, Artificial Sequence; identical to SEQ ID NO: 16738
  neuraminidase__InfluenzaA__ACR39476

SEQ ID NO: 16880 - protein, 469 aa, Artificial Sequence; identical to SEQ ID NO: 16738
  neuraminidase__InfluenzaA__ACR39486

SEQ ID NO: 16881 - protein, 469 aa, Artificial Sequence; identical to SEQ ID NO: 16738
  neuraminidase__InfluenzaA__ACR39496

SEQ ID NO: 16882 - protein, 469 aa, Artificial Sequence; identical to SEQ ID NO: 16738
  neuraminidase__InfluenzaA__ACR40291

SEQ ID NO: 16883 - protein, 469 aa, Artificial Sequence; identical to SEQ ID NO: 16738
  neuraminidase__InfluenzaA__ACR40301

SEQ ID NO: 16884 - protein, 469 aa, Artificial Sequence
  neuraminidase__InfluenzaA__ACR40311
MNPNQKIITIGSVCMTIGMANLILQIGNIISIWISHSIQLGNQNQTETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16885 - protein, 469 aa, Artificial Sequence
  neuraminidase__InfluenzaA__ACR40321
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWNGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16886 - protein, 469 aa, Artificial Sequence; identical to SEQ ID NO: 16738
  neuraminidase__InfluenzaA__ACR40341

SEQ ID NO: 16887 - protein, 469 aa, Artificial Sequence; identical to SEQ ID NO: 16738
  neuraminidase__InfluenzaA__ACR40351

SEQ ID NO: 16888 - protein, 469 aa, Artificial Sequence; identical to SEQ ID NO: 16738
  neuraminidase__InfluenzaA__ACR40361

SEQ ID NO: 16889 - protein, 469 aa, Artificial Sequence; identical to SEQ ID NO: 16738
  neuraminidase__InfluenzaA__ACR40371

SEQ ID NO: 16890 - protein, 469 aa, Artificial Sequence; identical to SEQ ID NO: 16738
  neuraminidase__InfluenzaA__ACR40391

SEQ ID NO: 16891 - protein, 469 aa, Artificial Sequence; identical to SEQ ID NO: 16728
  neuraminidase__InfluenzaA__ACR46663

SEQ ID NO: 16892 - protein, 469 aa, Artificial Sequence; identical to SEQ ID NO: 16728
  neuraminidase__InfluenzaA__ACR46673

SEQ ID NO: 16893 - protein, 469 aa, Artificial Sequence
  neuraminidase__InfluenzaA__ACR46996
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16894 - protein, 469 aa, Artificial Sequence; identical to SEQ ID NO: 16893
  neuraminidase__InfluenzaA__ACR46997

SEQ ID NO: 16895 - protein, 469 aa, Artificial Sequence; identical to SEQ ID NO: 16893
  neuraminidase__InfluenzaA__ACR46998

SEQ ID NO: 16896 - protein, 469 aa, Artificial Sequence; identical to SEQ ID NO: 16893
  neuraminidase__InfluenzaA__ACR46999

SEQ ID NO: 16897 - protein, 469 aa, Artificial Sequence; identical to SEQ ID NO: 16893
  neuraminidase__InfluenzaA__ACR47000

SEQ ID NO: 16898 - protein, 469 aa, Artificial Sequence; identical to SEQ ID NO: 16893
  neuraminidase__InfluenzaA__ACR47001

SEQ ID NO: 16899 - protein, 469 aa, Artificial Sequence; identical to SEQ ID NO: 16893
  neuraminidase__InfluenzaA__ACR47002

SEQ ID NO: 16900 - protein, 469 aa, Artificial Sequence; identical to SEQ ID NO: 16893
  neuraminidase__InfluenzaA__ACR47003

SEQ ID NO: 16901 - protein, 469 aa, Artificial Sequence
  neuraminidase__InfluenzaA__ACR47008
MNPNQKIITIGSVCMTIGMANLILQIGNIISIWPVHSIQLGNQNQIETCNQSVITYENNTWVNQTYVNISNTNFAAGQSVVSMKLAGNSSLCPVGGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16902 - protein, 469 aa, Artificial Sequence; identical to SEQ ID NO: 16738
  neuraminidase__InfluenzaA__ACR49267

SEQ ID NO: 16903 - protein, 469 aa, Artificial Sequence; identical to SEQ ID NO: 16728
  neuraminidase__InfluenzaA__ACR49268

SEQ ID NO: 16904 - protein, 469 aa, Artificial Sequence; identical to SEQ ID NO: 16728
  neuraminidase__InfluenzaA__ACR49269

SEQ ID NO: 16905 - protein, 469 aa, Artificial Sequence; identical to SEQ ID NO: 16728
  neuraminidase__InfluenzaA__ACR49270

SEQ ID NO: 16906 - protein, 469 aa, Artificial Sequence; identical to SEQ ID NO: 16768
  neuraminidase__InfluenzaA__ACR49271

SEQ ID NO: 16907 - protein, 469 aa, Artificial Sequence; identical to SEQ ID NO: 16738
  neuraminidase__InfluenzaA__ACR49272

SEQ ID NO: 16908 - protein, 469 aa, Artificial Sequence; identical to SEQ ID NO: 16728
  neuraminidase__InfluenzaA__ACR49273

SEQ ID NO: 16909 - protein, 469 aa, Artificial Sequence; identical to SEQ ID NO: 16728
  neuraminidase__InfluenzaA__ACR49274

SEQ ID NO: 16910 - protein, 469 aa, Artificial Sequence; identical to SEQ ID NO: 16768
  neuraminidase__InfluenzaA__ACR49275

SEQ ID NO: 16911 - protein, 469 aa, Artificial Sequence; identical to SEQ ID NO: 16768
  neuraminidase__InfluenzaA__ACR49277

SEQ ID NO: 16912 - protein, 469 aa, Artificial Sequence; identical to SEQ ID NO: 16768
  neuraminidase__InfluenzaA__ACR49278

SEQ ID NO: 16913 - protein, 469 aa, Artificial Sequence; identical to SEQ ID NO: 16728
  neuraminidase__InfluenzaA__ACR49279

SEQ ID NO: 16914 - protein, 469 aa, Artificial Sequence; identical to SEQ ID NO: 16728
  neuraminidase__InfluenzaA__ACR50994

SEQ ID NO: 16915 - protein, 469 aa, Artificial Sequence; identical to SEQ ID NO: 16738
  neuraminidase__InfluenzaA__ACR50998

SEQ ID NO: 16916 - protein, 469 aa, Artificial Sequence; identical to SEQ ID NO: 16738
  neuraminidase__InfluenzaA__ACR51008

SEQ ID NO: 16917 - protein, 469 aa, Artificial Sequence; identical to SEQ ID NO: 16738
  neuraminidase__InfluenzaA__ACR51018

SEQ ID NO: 16918 - protein, 469 aa, Artificial Sequence; identical to SEQ ID NO: 16738
  neuraminidase__InfluenzaA__ACR51028

SEQ ID NO: 16919 - protein, 469 aa, Artificial Sequence
  neuraminidase__InfluenzaA__ACR51038
MNPNQKIITIGSVCMSIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 16920 - protein, 469 aa, Artificial Sequence; identical to SEQ ID NO: 16738
  neuraminidase__InfluenzaA__ACR51048

SEQ ID NO: 16921 - protein, 469 aa, Artificial Sequence; identical to SEQ ID NO: 16738
  neuraminidase__InfluenzaA__ACR51058

SEQ ID NO: 16922 - protein, 469 aa, Artificial Sequence; identical to SEQ ID NO: 16728
  neuraminidase__InfluenzaA__ACR51068

SEQ ID NO: 16923 - protein, 469 aa, Artificial Sequence; identical to SEQ ID NO: 16738
  neuraminidase__InfluenzaA__ACR52371

SEQ ID NO: 16924 - protein, 469 aa, Artificial Sequence; identical to SEQ ID NO: 16738
  neuraminidase__InfluenzaA__ACR52381

SEQ ID NO: 16925 - protein, 469 aa, Artificial Sequence; identical to SEQ ID NO: 16738
  neuraminidase__InfluenzaA__ACR52391

SEQ ID NO: 16926 - protein, 469 aa, Artificial Sequence; identical to SEQ ID NO: 16738
  neuraminidase__InfluenzaA__ACR52401

SEQ ID NO: 16927 - protein, 469 aa, Artificial Sequence; identical to SEQ ID NO: 16738
  neuraminidase__InfluenzaA__ACR52411

SEQ ID NO: 16928 - protein, 469 aa, Artificial Sequence; identical to SEQ ID NO: 16738
  neuraminidase__InfluenzaA__ACR52421

SEQ ID NO: 16929 - protein, 469 aa, Artificial Sequence; identical to SEQ ID NO: 16738
  neuraminidase__InfluenzaA__ACR52431

SEQ ID NO: 16930 - protein, 469 aa, Artificial Sequence; identical to SEQ ID NO: 16738
  neuraminidase__InfluenzaA__ACR52441

SEQ ID NO: 16931 - protein, 469 aa, Artificial Sequence; identical to SEQ ID NO: 16738
  neuraminidase__InfluenzaA__ACR52451

SEQ ID NO: 16932 - protein, 469 aa, Artificial Sequence; identical to SEQ ID NO: 16738
  neuraminidase__InfluenzaA__ACR52471

SEQ ID NO: 16933 - protein, 469 aa, Artificial Sequence; identical to SEQ ID NO: 16738
  neuraminidase__InfluenzaA__ACR52481

SEQ ID NO: 16934 - protein, 469 aa, Artificial Sequence; identical to SEQ ID NO: 16738
  neuraminidase__InfluenzaA__ACR52491

SEQ ID NO: 16935 - protein, 469 aa, Artificial Sequence; identical to SEQ ID NO: 16738
  neuraminidase__InfluenzaA__ACR54046

SEQ ID NO: 16936 - protein, 469 aa, Artificial Sequence; identical to SEQ ID NO: 16728
  neuraminidase__InfluenzaA__ACR54052

SEQ ID NO: 16937 - protein, 469 aa, Artificial Sequence; identical to SEQ ID NO: 16738
  neuraminidase__InfluenzaA__ACR54966

SEQ ID NO: 16938 - protein, 469 aa, Artificial Sequence; identical to SEQ ID NO: 16738
  neuraminidase__InfluenzaA__ACR54976

SEQ ID NO: 16939 - protein, 469 aa, Artificial Sequence; identical to SEQ ID NO: 16738
  neuraminidase__InfluenzaA__ACR54986

SEQ ID NO: 16940 - protein, 469 aa, Artificial Sequence; identical to SEQ ID NO: 16728
  neuraminidase__InfluenzaA__ACR54996

SEQ ID NO: 16941 - protein, 469 aa, Artificial Sequence; identical to SEQ ID NO: 16738
  neuraminidase__InfluenzaA__ACR55006

SEQ ID NO: 16942 - protein, 469 aa, Artificial Sequence; identical to SEQ ID NO: 16728
  neuraminidase__InfluenzaA__ACR56383

SEQ ID NO: 16943 - protein, 469 aa, Artificial Sequence; identical to SEQ ID NO: 16728
  neuraminidase__InfluenzaA__ACR56393

SEQ ID NO: 16944 - protein, 469 aa, Artificial Sequence; identical to SEQ ID NO: 16738
  neuraminidase__InfluenzaA__ACR56403

SEQ ID NO: 16945 - protein, 469 aa, Artificial Sequence; identical to SEQ ID NO: 16738
  neuraminidase__InfluenzaA__ACR56413

SEQ ID NO: 16946 - protein, 469 aa, Artificial Sequence; identical to SEQ ID NO: 16738
  neuraminidase__InfluenzaA__ACR56423

SEQ ID NO: 16947 - protein, 469 aa, Artificial Sequence; identical to SEQ ID NO: 16738
  neuraminidase__InfluenzaA__ACR56433

SEQ ID NO: 16948 - protein, 469 aa, Artificial Sequence; identical to SEQ ID NO: 16738
  neuraminidase__InfluenzaA__ACR56443

SEQ ID NO: 16949 - protein, 469 aa, Artificial Sequence; identical to SEQ ID NO: 16738
  neuraminidase__InfluenzaA__ACR56453

SEQ ID NO: 16950 - protein, 470 aa, Artificial Sequence; identical to SEQ ID NO: 16716
  neuraminidase__InfluenzaA__ACR58555

SEQ ID NO: 16951 - protein, 470 aa, Artificial Sequence
  neuraminidase__InfluenzaA__ACR61658
MNPNQKIITIGSISIAIGIISLMLQIGNIISIWASHSIQTGSQNHTGICNQRIITYENSTWVNHTYVSINNTNVVTGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 16952 - protein, 469 aa, Artificial Sequence
  neuraminidase__InfluenzaA__ACR61680
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCIVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16953 - protein, 469 aa, Artificial Sequence
  neuraminidase__InfluenzaA__ACR61691
MNPNQKIITIGSVSLTISTICFFMQIAILITTVTLHFKQYEFNSPPNNQVMLCEPTIIERNITEIVYLTNTTIEKEICHKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16954 - protein, 469 aa, Artificial Sequence
  neuraminidase__InfluenzaA__ACR61702
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSNCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 16955 - protein, 469 aa, Artificial Sequence; identical to SEQ ID NO: 16728
  neuraminidase__InfluenzaA__ACR67201

SEQ ID NO: 16956 - protein, 469 aa, Artificial Sequence; identical to SEQ ID NO: 16738
  neuraminidase__InfluenzaA__ACR67202

SEQ ID NO: 16957 - protein, 469 aa, Artificial Sequence; identical to SEQ ID NO: 16728
  neuraminidase__InfluenzaA__ACR67203

SEQ ID NO: 16958 - protein, 469 aa, Artificial Sequence; identical to SEQ ID NO: 16738
  neuraminidase__InfluenzaA__ACR67204

SEQ ID NO: 16959 - protein, 469 aa, Artificial Sequence; identical to SEQ ID NO: 16738
  neuraminidase__InfluenzaA__ACR67246

SEQ ID NO: 16960 - protein, 469 aa, Artificial Sequence; identical to SEQ ID NO: 16728
  neuraminidase__InfluenzaA__ACR67256

SEQ ID NO: 16961 - protein, 469 aa, Artificial Sequence; identical to SEQ ID NO: 16738
  neuraminidase__InfluenzaA__ACR77451

SEQ ID NO: 16962 - protein, 469 aa, Artificial Sequence; identical to SEQ ID NO: 16738
  neuraminidase__InfluenzaA__ACR77461

SEQ ID NO: 16963 - protein, 469 aa, Artificial Sequence; identical to SEQ ID NO: 16738
  neuraminidase__InfluenzaA__ACR77471

SEQ ID NO: 16964 - protein, 469 aa, Artificial Sequence; identical to SEQ ID NO: 16738
  neuraminidase__InfluenzaA__ACR77481

SEQ ID NO: 16965 - protein, 469 aa, Artificial Sequence; identical to SEQ ID NO: 16738
  neuraminidase__InfluenzaA__ACR77491

SEQ ID NO: 16966 - protein, 469 aa, Artificial Sequence; identical to SEQ ID NO: 16738
  neuraminidase__InfluenzaA__ACR77501

SEQ ID NO: 16967 - protein, 469 aa, Artificial Sequence; identical to SEQ ID NO: 16738
  neuraminidase__InfluenzaA__ACR83527

SEQ ID NO: 16968 - protein, 469 aa, Artificial Sequence; identical to SEQ ID NO: 16738
  neuraminidase__InfluenzaA__ACR83539

SEQ ID NO: 16969 - protein, 469 aa, Artificial Sequence; identical to SEQ ID NO: 16738
  neuraminidase__InfluenzaA__ACS14669

SEQ ID NO: 16970 - protein, 469 aa, Artificial Sequence; identical to SEQ ID NO: 16738
  neuraminidase__InfluenzaA__ACS14679

SEQ ID NO: 16971 - protein, 469 aa, Artificial Sequence; identical to SEQ ID NO: 16738
  neuraminidase__InfluenzaA__ACS14689

SEQ ID NO: 16972 - protein, 469 aa, Artificial Sequence; identical to SEQ ID NO: 16738
  neuraminidase__InfluenzaA__ACS14699

SEQ ID NO: 16973 - protein, 469 aa, Artificial Sequence; identical to SEQ ID NO: 16738
  neuraminidase__InfluenzaA__ACS14709

SEQ ID NO: 16974 - protein, 469 aa, Artificial Sequence; identical to SEQ ID NO: 16738
  neuraminidase__InfluenzaA__ACS14719

SEQ ID NO: 16975 - protein, 469 aa, Artificial Sequence; identical to SEQ ID NO: 16738
  neuraminidase__InfluenzaA__ACS14729

SEQ ID NO: 16976 - protein, 469 aa, Artificial Sequence; identical to SEQ ID NO: 16738
  neuraminidase__InfluenzaA__ACS14739

SEQ ID NO: 16977 - protein, 469 aa, Artificial Sequence; identical to SEQ ID NO: 16728
  neuraminidase__InfluenzaA__ACS27192

SEQ ID NO: 16978 - protein, 469 aa, Artificial Sequence; identical to SEQ ID NO: 16738
  neuraminidase__InfluenzaA__ACS27202

SEQ ID NO: 16979 - protein, 469 aa, Artificial Sequence; identical to SEQ ID NO: 16738
  neuraminidase__InfluenzaA__ACS27212

SEQ ID NO: 16980 - protein, 469 aa, Artificial Sequence; identical to SEQ ID NO: 16728
  neuraminidase__InfluenzaA__ACS27222

SEQ ID NO: 16981 - protein, 469 aa, Artificial Sequence; identical to SEQ ID NO: 16738
  neuraminidase__InfluenzaA__ACS27232

SEQ ID NO: 16982 - protein, 469 aa, Artificial Sequence; identical to SEQ ID NO: 16728
  neuraminidase__InfluenzaA__ACS27242

SEQ ID NO: 16983 - protein, 469 aa, Artificial Sequence; identical to SEQ ID NO: 16738
  neuraminidase__InfluenzaA__ACS27252

SEQ ID NO: 16984 - protein, 469 aa, Artificial Sequence; identical to SEQ ID NO: 16728
  neuraminidase__InfluenzaA__ACS27771

SEQ ID NO: 16985 - protein, 469 aa, Artificial Sequence; identical to SEQ ID NO: 16893
  neuraminidase__InfluenzaA__ACS34969

SEQ ID NO: 16986 - protein, 469 aa, Artificial Sequence; identical to SEQ ID NO: 16893
  neuraminidase__InfluenzaA__ACS34970

SEQ ID NO: 16987 - protein, 469 aa, Artificial Sequence; identical to SEQ ID NO: 16893
  neuraminidase__InfluenzaA__ACS34971

SEQ ID NO: 16988 - protein, 469 aa, Artificial Sequence; identical to SEQ ID NO: 16738
  neuraminidase__InfluenzaA__ACS34972

SEQ ID NO: 16989 - protein, 469 aa, Artificial Sequence; identical to SEQ ID NO: 16738
  neuraminidase__InfluenzaA__ACS50081

SEQ ID NO: 16990 - protein, 469 aa, Artificial Sequence; identical to SEQ ID NO: 16738
  neuraminidase__InfluenzaA__ACS50087

SEQ ID NO: 16991 - protein, 469 aa, Artificial Sequence; identical to SEQ ID NO: 16738
  neuraminidase__InfluenzaA__ACS50094

SEQ ID NO: 16992 - protein, 469 aa, Artificial Sequence; identical to SEQ ID NO: 16728
  neuraminidase__InfluenzaA__ACS54264

SEQ ID NO: 16993 - protein, 469 aa, Artificial Sequence; identical to SEQ ID NO: 16893
  neuraminidase__InfluenzaA__ACS54265

SEQ ID NO: 16994 - protein, 469 aa, Artificial Sequence; identical to SEQ ID NO: 16738
  neuraminidase__InfluenzaA__ACS54266

SEQ ID NO: 16995 - protein, 469 aa, Artificial Sequence; identical to SEQ ID NO: 16738
  neuraminidase__InfluenzaA__ACS54267

SEQ ID NO: 16996 - protein, 469 aa, Artificial Sequence; identical to SEQ ID NO: 16738
  neuraminidase__InfluenzaA__ACS54268

SEQ ID NO: 16997 - protein, 469 aa, Artificial Sequence; identical to SEQ ID NO: 16738
  neuraminidase__InfluenzaA__ACS54303

SEQ ID NO: 16998 - protein, 469 aa, Artificial Sequence; identical to SEQ ID NO: 16738
  neuraminidase__InfluenzaA__ACS68823

SEQ ID NO: 16999 - protein, 469 aa, Artificial Sequence; identical to SEQ ID NO: 16738
  neuraminidase__InfluenzaA__ACS75824

SEQ ID NO: 17000 - protein, 469 aa, Artificial Sequence; identical to SEQ ID NO: 16738
  neuraminidase__InfluenzaA__ACS77929

SEQ ID NO: 17001 - protein, 469 aa, Artificial Sequence; identical to SEQ ID NO: 16738
  neuraminidase__InfluenzaA__ACS77939

SEQ ID NO: 17002 - protein, 469 aa, Artificial Sequence; identical to SEQ ID NO: 16728
  neuraminidase__InfluenzaA__ACS77949

SEQ ID NO: 17003 - protein, 469 aa, Artificial Sequence; identical to SEQ ID NO: 16738
  neuraminidase__InfluenzaA__ACS77959

SEQ ID NO: 17004 - protein, 469 aa, Artificial Sequence; identical to SEQ ID NO: 16738
  neuraminidase__InfluenzaA__ACS77969

SEQ ID NO: 17005 - protein, 469 aa, Artificial Sequence; identical to SEQ ID NO: 16738
  neuraminidase__InfluenzaA__ACS77979

SEQ ID NO: 17006 - protein, 469 aa, Artificial Sequence; identical to SEQ ID NO: 16738
  neuraminidase__InfluenzaA__ACS77989

SEQ ID NO: 17007 - protein, 469 aa, Artificial Sequence; identical to SEQ ID NO: 16738
  neuraminidase__InfluenzaA__ACS77999

SEQ ID NO: 17008 - protein, 469 aa, Artificial Sequence; identical to SEQ ID NO: 16738
  neuraminidase__InfluenzaA__ACS78009

SEQ ID NO: 17009 - protein, 469 aa, Artificial Sequence; identical to SEQ ID NO: 16738
  neuraminidase__InfluenzaA__ACS78019

SEQ ID NO: 17010 - protein, 469 aa, Artificial Sequence; identical to SEQ ID NO: 16738
  neuraminidase__InfluenzaA__ACS78039

SEQ ID NO: 17011 - protein, 469 aa, Artificial Sequence; identical to SEQ ID NO: 16738
  neuraminidase__InfluenzaA__ACS78049

SEQ ID NO: 17012 - protein, 469 aa, Artificial Sequence; identical to SEQ ID NO: 16738
  neuraminidase__InfluenzaA__ACS88274

SEQ ID NO: 17013 - protein, 469 aa, Artificial Sequence; identical to SEQ ID NO: 16738
  neuraminidase__InfluenzaA__ACS88275

SEQ ID NO: 17014 - protein, 469 aa, Artificial Sequence; identical to SEQ ID NO: 16728
  neuraminidase__InfluenzaA__ACS92572

SEQ ID NO: 17015 - protein, 469 aa, Artificial Sequence; identical to SEQ ID NO: 16728
  neuraminidase__InfluenzaA__ACS92582

SEQ ID NO: 17016 - protein, 469 aa, Artificial Sequence; identical to SEQ ID NO: 16738
  neuraminidase__InfluenzaA__ACS92592

SEQ ID NO: 17017 - protein, 469 aa, Artificial Sequence; identical to SEQ ID NO: 16738
  neuraminidase__InfluenzaA__ACS92603

SEQ ID NO: 17018 - protein, 469 aa, Artificial Sequence; identical to SEQ ID NO: 16728
  neuraminidase__InfluenzaA__ACS92614

SEQ ID NO: 17019 - protein, 469 aa, Artificial Sequence; identical to SEQ ID NO: 16738
  neuraminidase__InfluenzaA__ACT09115

SEQ ID NO: 17020 - protein, 469 aa, Artificial Sequence; identical to SEQ ID NO: 16738
  neuraminidase__InfluenzaA__ACT10309

SEQ ID NO: 17021 - protein, 469 aa, Artificial Sequence; identical to SEQ ID NO: 16738
  neuraminidase__InfluenzaA__ACT10315

SEQ ID NO: 17022 - protein, 469 aa, Artificial Sequence; identical to SEQ ID NO: 16728
  neuraminidase__InfluenzaA__ACT11059

SEQ ID NO: 17023 - protein, 449 aa, Artificial Sequence
  neuraminidase__InfluenzaA__ACT15313
MNPNQKIITIGSICMVIGIVSLMLQIGNMISIWVSHSIQTGNQCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 17024 - protein, 449 aa, Artificial Sequence
  neuraminidase__InfluenzaA__ACT15315
MNPNQKIITIGSICMVIGIVSLMLQIGNMISIWVSHSIQTGNQCQDEPISNTKFLTEKAVASVTLAGNSSLCPISGWAVYSKDNSIRIGSRGDVFVMREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 17025 - protein, 449 aa, Artificial Sequence; identical to SEQ ID NO: 17023
  neuraminidase__InfluenzaA__ACT15319

SEQ ID NO: 17026 - protein, 449 aa, Artificial Sequence
  neuraminidase__InfluenzaA__ACT15321
MNPNQKIITIGSICMVIGIVSLMLQIGNMISIWVSHSIQTGNQCQDEPISNTKFLTERAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 17027 - protein, 449 aa, Artificial Sequence; identical to SEQ ID NO: 17023
  neuraminidase__InfluenzaA__ACT15323

SEQ ID NO: 17028 - protein, 449 aa, Artificial Sequence; identical to SEQ ID NO: 17023
  neuraminidase__InfluenzaA__ACT15325

SEQ ID NO: 17029 - protein, 449 aa, Artificial Sequence
  neuraminidase__InfluenzaA__ACT15327
MNPNQKIITIGSICMVIGIVSLMLQIGNMISIWVSHSIQTGNRCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYKIGYICSGIFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 17030 - protein, 449 aa, Artificial Sequence
  neuraminidase__InfluenzaA__ACT15331
MNPNQKIITIGSICMVIGIVSLMLQIGNMISIWVSHSIQTGNQCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 17031 - protein, 449 aa, Artificial Sequence
  neuraminidase__InfluenzaA__ACT15333
MNPNQKIITIGSICMVIGIVSLMLQIGNMISIWVSHSIQTGNQCQGEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVVSNGAYGVKGFSFKYGNGVWIGRTKSTNSRSGFEMIWDPNGWTGTDSSFSGKQDIVAITDWSGYSGSFVQHPELTGLDCIRPCFWVELIRGRPKESTIWTSGSSISFCGVNSDTVSWSWPDGAELPFTIDK

SEQ ID NO: 17032 - protein, 449 aa, Artificial Sequence
  neuraminidase__InfluenzaA__ACT15335
MNPNQKIITIGSICMVIGIVSLMLQIGNMISIWVSHSIQTGNRCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYKIGYICSGIFGDNPRPNDGTGSCGPVLPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 17033 - protein, 449 aa, Artificial Sequence
  neuraminidase__InfluenzaA__ACT15337
MNPNQKIITIGSICMVIGIVSLMLQIGNMISIWVSHSIQTGNQCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAVTDWSGYSGSFVQHPELTGLDCIRPCFWVELIRGRPKESTIWTSGSSISFCGVNGDTVSWSWPDGAELPFTIDK

SEQ ID NO: 17034 - protein, 449 aa, Artificial Sequence; identical to SEQ ID NO: 17023
  neuraminidase__InfluenzaA__ACT15341

SEQ ID NO: 17035 - protein, 449 aa, Artificial Sequence
  neuraminidase__InfluenzaA__ACT15344
MNPNQKIITIGSICMVIGIVSLMLQIGNMISIWVSHSIQTGNQCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRSNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 17036 - protein, 449 aa, Artificial Sequence
  neuraminidase__InfluenzaA__ACT15346
MNPNQKIITIGSICMVIGIVSLMLQIGNMISIWVSHSIQTGNQCQDEPISNTKFLTEKAVASVTLAGNSSLCPISGWAVYSKDNNIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 17037 - protein, 449 aa, Artificial Sequence
  neuraminidase__InfluenzaA__ACT15348
MNPNQKIITIGSICMVIGTVSLMLQIGNMISIWVSHSIQTGNQCQGEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVVSNGAYGVKGFSFKYGNGVWIGRTKSTNSRSGFEMIWDPNGWTGTDSSFSGKQDIVAITDWSGYSGSFVQHPELTGLDCIRPCFWVELIRGRPKESTIWTSGSSISFCGVNSDTVSWSWPDGAELPFTIDK

SEQ ID NO: 17038 - protein, 449 aa, Artificial Sequence
  neuraminidase__InfluenzaA__ACT15350
MNPNQKIITIGSICMVIGIVSLMLQIGNMISIWVSHSIQTGNRCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYKIGYICSGIFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKERTIWTSGSSISFCGVNGDTVSWSWPDGAELPFTIDK

SEQ ID NO: 17039 - protein, 449 aa, Artificial Sequence
  neuraminidase__InfluenzaA__ACT15352
MNPNQKIITIGSICMVIGIVSLMLQIGNMISIWVSHSIQTGNQCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVVSNGAYGVKGFSFKYGNGVWIGRTKSTNSRSGFEMIWDPNGWTGTDSSFSGKQDIVAITDWSGYSGSFVQHPELTGLDCIRPCFWVELIRGRPKESTIWTSGSSISFCGVNSDTVSWSWPDGAELPFTIDK

SEQ ID NO: 17040 - protein, 449 aa, Artificial Sequence
  neuraminidase__InfluenzaA__ACT15354
MNPSQKIITIGSICMVIGIVSLMLQIGNMISIWISHSIQTGNQCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 17041 - protein, 449 aa, Artificial Sequence
  neuraminidase__InfluenzaA__ACT15356
MNPNQKIITIGSICMVIGIVSLMLQIGNMISIWVSHSIQTGNQCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFSNGAYGVKGFSFKYGNGVWIGRTKSTNSRSGFEMIWDPNGWTGTDSSFSGKQDIVAITDWSGYSGSFVQHPELTGLDCIRPCFWVELIRGRPKESTIWTSGSSISFCGVNSDTVSWSWPDGAELPFTIDK

SEQ ID NO: 17042 - protein, 449 aa, Artificial Sequence
  neuraminidase__InfluenzaA__ACT15358
MNPNQKIITIGSICMVIGIVSLMLQIGNMISIWVSHSIQTGNRCQDEPISNTKFLTEKAVASVTLAGNSSLCPISGWAVYSKDNSIRIGSRGDVFVIREPFISCSHLECRTFFLTHGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWISFNQNLEYKIGYICSGIFGDNPRPNDGTGSCGPVLPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 17043 - protein, 469 aa, Artificial Sequence; identical to SEQ ID NO: 14327
  neuraminidase__InfluenzaA__ACT21515

SEQ ID NO: 17044 - protein, 469 aa, Artificial Sequence
  neuraminidase__InfluenzaA__ACT21516
MNPNQKIITIGSVSLTISTICFFMQIAILITTVTLHFKQYEFNSPPNNQVMLCEPTIIERNITEIAYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCVAWSSSSCHDGKAWLHVCVTGDEKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEENEVLWTSNSIVVFCGTSGTYGTGSWPDGADINLMPI

SEQ ID NO: 17045 - protein, 469 aa, Artificial Sequence
  neuraminidase__InfluenzaA__ACT21517
MNPNQKIITIGSVSLTISTICFFMQIAILITTVTLHFKQYEFNSPPNNQVMLCEPTIIERNITEIVYLTNTTIEKEICPKLAEYRNWSEPQCDITGFAPFSKDNSIRLSAGGDIWVTREPYVSCDPDKCYQFALGQGTTLNNVHSNDTVHDRTPYRTLVMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLAGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 17046 - protein, 469 aa, Artificial Sequence; identical to SEQ ID NO: 16738
  neuraminidase__InfluenzaA__ACT21574

SEQ ID NO: 17047 - protein, 469 aa, Artificial Sequence; identical to SEQ ID NO: 16738
  neuraminidase__InfluenzaA__ACT21585

SEQ ID NO: 17048 - protein, 469 aa, Artificial Sequence; identical to SEQ ID NO: 16738
  neuraminidase__InfluenzaA__ACT22011

SEQ ID NO: 17049 - protein, 469 aa, Artificial Sequence; identical to SEQ ID NO: 16738
  neuraminidase__InfluenzaA__ACT22012

SEQ ID NO: 17050 - protein, 469 aa, Artificial Sequence; identical to SEQ ID NO: 16738
  neuraminidase__InfluenzaA__ACT22013

SEQ ID NO: 17051 - protein, 469 aa, Artificial Sequence; identical to SEQ ID NO: 16738
  neuraminidase__InfluenzaA__ACT22014

SEQ ID NO: 17052 - protein, 469 aa, Artificial Sequence; identical to SEQ ID NO: 16728
  neuraminidase__InfluenzaA__ACT22015

SEQ ID NO: 17053 - protein, 469 aa, Artificial Sequence
  neuraminidase__InfluenzaA__ACT22016
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17054 - protein, 469 aa, Artificial Sequence; identical to SEQ ID NO: 16738
  neuraminidase__InfluenzaA__ACT22017

SEQ ID NO: 17055 - protein, 469 aa, Artificial Sequence; identical to SEQ ID NO: 16738
  neuraminidase__InfluenzaA__ACT22018

SEQ ID NO: 17056 - protein, 469 aa, Artificial Sequence; identical to SEQ ID NO: 16728
  neuraminidase__InfluenzaA__ACT22506

SEQ ID NO: 17057 - protein, 469 aa, Artificial Sequence; identical to SEQ ID NO: 16738
  neuraminidase__InfluenzaA__ACT22511

SEQ ID NO: 17058 - protein, 469 aa, Artificial Sequence; identical to SEQ ID NO: 16738
  neuraminidase__InfluenzaA__ACT33121

SEQ ID NO: 17059 - protein, 469 aa, Artificial Sequence; identical to SEQ ID NO: 16738
  neuraminidase__InfluenzaA__ACT33124

SEQ ID NO: 17060 - protein, 469 aa, Artificial Sequence; identical to SEQ ID NO: 16738
  neuraminidase__InfluenzaA__ACT33126

SEQ ID NO: 17061 - protein, 469 aa, Artificial Sequence; identical to SEQ ID NO: 16728
  neuraminidase__InfluenzaA__ACT35526

SEQ ID NO: 17062 - protein, 469 aa, Artificial Sequence; identical to SEQ ID NO: 16738
  neuraminidase__InfluenzaA__ACT36507

SEQ ID NO: 17063 - protein, 469 aa, Artificial Sequence; identical to SEQ ID NO: 16738
  neuraminidase__InfluenzaA__ACT36672

SEQ ID NO: 17064 - protein, 469 aa, Artificial Sequence; identical to SEQ ID NO: 16738
  neuraminidase__InfluenzaA__ACT36673

SEQ ID NO: 17065 - protein, 469 aa, Artificial Sequence; identical to SEQ ID NO: 16738
  neuraminidase__InfluenzaA__ACT36674

SEQ ID NO: 17066 - protein, 469 aa, Artificial Sequence; identical to SEQ ID NO: 16738
  neuraminidase__InfluenzaA__ACT36675

SEQ ID NO: 17067 - protein, 469 aa, Artificial Sequence; identical to SEQ ID NO: 16738
  neuraminidase__InfluenzaA__ACT36677

SEQ ID NO: 17068 - protein, 469 aa, Artificial Sequence
  neuraminidase__InfluenzaA__ACT36678
MNPNQKIITIGSVCMTIGMANLILQIGNIISIWISHSIQLGNQNQIETCNQSVITYENNTWVNQTYVNISNTNFAARQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17069 - protein, 469 aa, Artificial Sequence; identical to SEQ ID NO: 16728
  neuraminidase__InfluenzaA__ACT36679

SEQ ID NO: 17070 - protein, 469 aa, Artificial Sequence; identical to SEQ ID NO: 16738
  neuraminidase__InfluenzaA__ACT36680

SEQ ID NO: 17071 - protein, 469 aa, Artificial Sequence; identical to SEQ ID NO: 16728
  neuraminidase__InfluenzaA__ACT36682

SEQ ID NO: 17072 - protein, 469 aa, Artificial Sequence; identical to SEQ ID NO: 16728
  neuraminidase__InfluenzaA__ACT36683

SEQ ID NO: 17073 - protein, 469 aa, Artificial Sequence; identical to SEQ ID NO: 16738
  neuraminidase__InfluenzaA__ACT36684

SEQ ID NO: 17074 - protein, 469 aa, Artificial Sequence; identical to SEQ ID NO: 16728
  neuraminidase__InfluenzaA__ACT36685

SEQ ID NO: 17075 - protein, 469 aa, Artificial Sequence; identical to SEQ ID NO: 16728
  neuraminidase__InfluenzaA__ACT36686

SEQ ID NO: 17076 - protein, 469 aa, Artificial Sequence; identical to SEQ ID NO: 16728
  neuraminidase__InfluenzaA__ACT36687

SEQ ID NO: 17077 - protein, 469 aa, Artificial Sequence
  neuraminidase__InfluenzaA__ACT36688
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSYKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17078 - protein, 469 aa, Artificial Sequence; identical to SEQ ID NO: 16728
  neuraminidase__InfluenzaA__ACT36689

SEQ ID NO: 17079 - protein, 469 aa, Artificial Sequence; identical to SEQ ID NO: 16768
  neuraminidase__InfluenzaA__ACT36690

SEQ ID NO: 17080 - protein, 469 aa, Artificial Sequence; identical to SEQ ID NO: 16728
  neuraminidase__InfluenzaA__ACT36691

SEQ ID NO: 17081 - protein, 469 aa, Artificial Sequence; identical to SEQ ID NO: 16768
  neuraminidase__InfluenzaA__ACT36693

SEQ ID NO: 17082 - protein, 469 aa, Artificial Sequence; identical to SEQ ID NO: 16738
  neuraminidase__InfluenzaA__ACT36694

SEQ ID NO: 17083 - protein, 469 aa, Artificial Sequence; identical to SEQ ID NO: 16738
  neuraminidase__InfluenzaA__ACT36695

SEQ ID NO: 17084 - protein, 469 aa, Artificial Sequence; identical to SEQ ID NO: 16738
  neuraminidase__InfluenzaA__ACT52684

SEQ ID NO: 17085 - protein, 469 aa, Artificial Sequence; identical to SEQ ID NO: 16728
  neuraminidase__InfluenzaA__ACT54608

SEQ ID NO: 17086 - protein, 469 aa, Artificial Sequence
  neuraminidase__InfluenzaA__ACT66157
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKILRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17087 - protein, 469 aa, Artificial Sequence; identical to SEQ ID NO: 16738
  neuraminidase__InfluenzaA__ACT67117

SEQ ID NO: 17088 - protein, 469 aa, Artificial Sequence; identical to SEQ ID NO: 16728
  neuraminidase__InfluenzaA__ACT67121

SEQ ID NO: 17089 - protein, 469 aa, Artificial Sequence; identical to SEQ ID NO: 16738
  neuraminidase__InfluenzaA__ACT67240

SEQ ID NO: 17090 - protein, 469 aa, Artificial Sequence; identical to SEQ ID NO: 16738
  neuraminidase__InfluenzaA__ACT67241

SEQ ID NO: 17091 - protein, 469 aa, Artificial Sequence; identical to SEQ ID NO: 16738
  neuraminidase__InfluenzaA__ACT67243

SEQ ID NO: 17092 - protein, 469 aa, Artificial Sequence
  neuraminidase__InfluenzaA__ACT67256
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17093 - protein, 469 aa, Artificial Sequence
  neuraminidase__InfluenzaA__ACT68161
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKAGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17094 - protein, 469 aa, Artificial Sequence; identical to SEQ ID NO: 16728
  neuraminidase__InfluenzaA__ACT68162

SEQ ID NO: 17095 - protein, 469 aa, Artificial Sequence; identical to SEQ ID NO: 16728
  neuraminidase__InfluenzaA__ACT68163

SEQ ID NO: 17096 - protein, 469 aa, Artificial Sequence; identical to SEQ ID NO: 16728
  neuraminidase__InfluenzaA__ACT68164

SEQ ID NO: 17097 - protein, 469 aa, Artificial Sequence; identical to SEQ ID NO: 16738
  neuraminidase__InfluenzaA__ACT68166

SEQ ID NO: 17098 - protein, 469 aa, Artificial Sequence; identical to SEQ ID NO: 16738
  neuraminidase__InfluenzaA__ACT68167

SEQ ID NO: 17099 - protein, 469 aa, Artificial Sequence; identical to SEQ ID NO: 16768
  neuraminidase__InfluenzaA__ACT68168

SEQ ID NO: 17100 - protein, 469 aa, Artificial Sequence
  neuraminidase__InfluenzaA__ACT68169
MNPNQKIITIGSVCMTIGMANLILQIGNIISIWISHSIQLGDQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNETIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGISEWSGYSGSFVQHPELTGLDCIRPCFWVELIRGRPKENTIWTSGSSISFCGVNSDTVGWSWPDGAELPFTIDK

SEQ ID NO: 17101 - protein, 469 aa, Artificial Sequence; identical to SEQ ID NO: 16728
  neuraminidase__InfluenzaA__ACT68171

SEQ ID NO: 17102 - protein, 469 aa, Artificial Sequence; identical to SEQ ID NO: 16728
  neuraminidase__InfluenzaA__ACT68172

SEQ ID NO: 17103 - protein, 469 aa, Artificial Sequence; identical to SEQ ID NO: 16738
  neuraminidase__InfluenzaA__ACT68173

SEQ ID NO: 17104 - protein, 469 aa, Artificial Sequence; identical to SEQ ID NO: 16738
  neuraminidase__InfluenzaA__ACT68174

SEQ ID NO: 17105 - protein, 469 aa, Artificial Sequence
  neuraminidase__InfluenzaA__ACT68175
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSGEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17106 - protein, 469 aa, Artificial Sequence; identical to SEQ ID NO: 16738
  neuraminidase__InfluenzaA__ACT68176

SEQ ID NO: 17107 - protein, 469 aa, Artificial Sequence; identical to SEQ ID NO: 16738
  neuraminidase__InfluenzaA__ACT68177

SEQ ID NO: 17108 - protein, 469 aa, Artificial Sequence; identical to SEQ ID NO: 16738
  neuraminidase__InfluenzaA__ACT68178

SEQ ID NO: 17109 - protein, 469 aa, Artificial Sequence; identical to SEQ ID NO: 17105
  neuraminidase__InfluenzaA__ACT68179

SEQ ID NO: 17110 - protein, 469 aa, Artificial Sequence; identical to SEQ ID NO: 16738
  neuraminidase__InfluenzaA__ACT68180

SEQ ID NO: 17111 - protein, 469 aa, Artificial Sequence; identical to SEQ ID NO: 16768
  neuraminidase__InfluenzaA__ACT79145

SEQ ID NO: 17112 - protein, 469 aa, Artificial Sequence
  neuraminidase__InfluenzaA__ACT79155
MNPNQKIITIGSVCMTIGMANLILQIGNIISIWISHSIQLGNQNQIETCNQSVITYENNTWVNQTYVNISNTNFAAGQSVVSVKLAGNSSLCPVGGWAIYSKDNSVRIGSKGDVFVIREPFISCSLLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17113 - protein, 469 aa, Artificial Sequence; identical to SEQ ID NO: 16728
  neuraminidase__InfluenzaA__ACT79165

SEQ ID NO: 17114 - protein, 469 aa, Artificial Sequence; identical to SEQ ID NO: 16728
  neuraminidase__InfluenzaA__ACT79175

SEQ ID NO: 17115 - protein, 469 aa, Artificial Sequence; identical to SEQ ID NO: 16738
  neuraminidase__InfluenzaA__ACT79185

SEQ ID NO: 17116 - protein, 469 aa, Artificial Sequence; identical to SEQ ID NO: 16738
  neuraminidase__InfluenzaA__ACT79622

SEQ ID NO: 17117 - protein, 469 aa, Artificial Sequence; identical to SEQ ID NO: 17105
  neuraminidase__InfluenzaA__ACT79630

SEQ ID NO: 17118 - protein, 469 aa, Artificial Sequence; identical to SEQ ID NO: 16738
  neuraminidase__InfluenzaA__ACT83798

SEQ ID NO: 17119 - protein, 469 aa, Artificial Sequence; identical to SEQ ID NO: 16738
  neuraminidase__InfluenzaA__ACT83808

SEQ ID NO: 17120 - protein, 469 aa, Artificial Sequence; identical to SEQ ID NO: 16738
  neuraminidase__InfluenzaA__ACT83818

SEQ ID NO: 17121 - protein, 469 aa, Artificial Sequence; identical to SEQ ID NO: 16738
  neuraminidase__InfluenzaA__ACT83828

SEQ ID NO: 17122 - protein, 469 aa, Artificial Sequence; identical to SEQ ID NO: 16738
  neuraminidase__InfluenzaA__ACT83838

SEQ ID NO: 17123 - protein, 469 aa, Artificial Sequence; identical to SEQ ID NO: 16728
  neuraminidase__InfluenzaA__ACT83848

SEQ ID NO: 17124 - protein, 469 aa, Artificial Sequence; identical to SEQ ID NO: 16728
  neuraminidase__InfluenzaA__ACT83858

SEQ ID NO: 17125 - protein, 469 aa, Artificial Sequence; identical to SEQ ID NO: 16738
  neuraminidase__InfluenzaA__ACT83868

SEQ ID NO: 17126 - protein, 469 aa, Artificial Sequence; identical to SEQ ID NO: 16738
  neuraminidase__InfluenzaA__ACT83878

SEQ ID NO: 17127 - protein, 469 aa, Artificial Sequence; identical to SEQ ID NO: 16738
  neuraminidase__InfluenzaA__ACT86002

SEQ ID NO: 17128 - protein, 469 aa, Artificial Sequence; identical to SEQ ID NO: 16738
  neuraminidase__InfluenzaA__ACT86012

SEQ ID NO: 17129 - protein, 469 aa, Artificial Sequence; identical to SEQ ID NO: 16738
  neuraminidase__InfluenzaA__ACT86022

SEQ ID NO: 17130 - protein, 469 aa, Artificial Sequence; identical to SEQ ID NO: 16728
  neuraminidase__InfluenzaA__ACT86032

SEQ ID NO: 17131 - protein, 469 aa, Artificial Sequence; identical to SEQ ID NO: 16738
  neuraminidase__InfluenzaA__ACT86042

SEQ ID NO: 17132 - protein, 469 aa, Artificial Sequence; identical to SEQ ID NO: 16738
  neuraminidase__InfluenzaA__ACT86052

SEQ ID NO: 17133 - protein, 469 aa, Artificial Sequence; identical to SEQ ID NO: 16738
  neuraminidase__InfluenzaA__ACT86062

SEQ ID NO: 17134 - protein, 469 aa, Artificial Sequence; identical to SEQ ID NO: 16738
  neuraminidase__InfluenzaA__ACT86072

SEQ ID NO: 17135 - protein, 469 aa, Artificial Sequence; identical to SEQ ID NO: 16738
  neuraminidase__InfluenzaA__ACT86082

SEQ ID NO: 17136 - protein, 469 aa, Artificial Sequence; identical to SEQ ID NO: 16738
  neuraminidase__InfluenzaA__ACT86092

SEQ ID NO: 17137 - protein, 469 aa, Artificial Sequence; identical to SEQ ID NO: 16738
  neuraminidase__InfluenzaA__ACT86102

SEQ ID NO: 17138 - protein, 469 aa, Artificial Sequence; identical to SEQ ID NO: 16738
  neuraminidase__InfluenzaA__ACT86112

SEQ ID NO: 17139 - protein, 469 aa, Artificial Sequence; identical to SEQ ID NO: 16738
  neuraminidase__InfluenzaA__ACT86122

SEQ ID NO: 17140 - protein, 469 aa, Artificial Sequence; identical to SEQ ID NO: 16738
  neuraminidase__InfluenzaA__ACT86132

SEQ ID NO: 17141 - protein, 469 aa, Artificial Sequence; identical to SEQ ID NO: 16738
  neuraminidase__InfluenzaA__ACT86142

SEQ ID NO: 17142 - protein, 469 aa, Artificial Sequence; identical to SEQ ID NO: 16728
  neuraminidase__InfluenzaA__ACT97323

SEQ ID NO: 17143 - protein, 469 aa, Artificial Sequence; identical to SEQ ID NO: 16738
  neuraminidase__InfluenzaA__ACU00934

SEQ ID NO: 17144 - protein, 469 aa, Artificial Sequence; identical to SEQ ID NO: 16738
  neuraminidase__InfluenzaA__ACU00944

SEQ ID NO: 17145 - protein, 469 aa, Artificial Sequence; identical to SEQ ID NO: 17092
  neuraminidase__InfluenzaA__ACU00954

SEQ ID NO: 17146 - protein, 469 aa, Artificial Sequence
  neuraminidase__InfluenzaA__ACU12497
MNPNQKIITIGSVSLTIATICFLMQIAILVTTVTLHFKQYECNSPPNNQVMPCEPTIIERNITEIVYLTNTTIEREICPKLVEYRNWSKPQCRVTGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIVSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQTNRQVIVDRGNRSGYSGIFSVEGKSCINRCFYVELIRGRKQETKVWWTSNSIVVFCGTSGTYGTGSWPDGADINLMPI

SEQ ID NO: 17147 - protein, 470 aa, Artificial Sequence; identical to SEQ ID NO: 16632
  neuraminidase__InfluenzaA__ACU12508

SEQ ID NO: 17148 - protein, 469 aa, Artificial Sequence
  neuraminidase__InfluenzaA__ACU12519
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCITGDDENATASFIYNGRLVDSVVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRNQETEVLWTSNSIVVFCGTSGTYGTGSWPDGADINLMPI

SEQ ID NO: 17149 - protein, 469 aa, Artificial Sequence
  neuraminidase__InfluenzaA__ACU12530
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGNDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 17150 - protein, 469 aa, Artificial Sequence
  neuraminidase__InfluenzaA__ACU12541
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKWQINRQVIVDRGNRSGYSGIFSVEGKSCINRCFYVELIRGRKEETEVLWTSNSIVVFCGTSGTYGTGSWPDGADINLMPI

SEQ ID NO: 17151 - protein, 469 aa, Artificial Sequence
  neuraminidase__InfluenzaA__ACU12552
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSGYVCSGLVGDTPRKNDSSSSSHCSDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 17152 - protein, 470 aa, Artificial Sequence
  neuraminidase__InfluenzaA__ACU12574
MNPNQKIITIGSISIAIGIINLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17153 - protein, 470 aa, Artificial Sequence; identical to SEQ ID NO: 16632
  neuraminidase__InfluenzaA__ACU12585

SEQ ID NO: 17154 - protein, 470 aa, Artificial Sequence
  neuraminidase__InfluenzaA__ACU12596
MNPNQKIITIGSISIAIGIISLMLQIGSIISIWASHSIRTGSQNNTGICNQRIITYENSTWVNHTYVNINNTNVVAGEDKKSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17155 - protein, 469 aa, Artificial Sequence; identical to SEQ ID NO: 16738
  neuraminidase__InfluenzaA__ACU13077

SEQ ID NO: 17156 - protein, 469 aa, Artificial Sequence; identical to SEQ ID NO: 16738
  neuraminidase__InfluenzaA__ACU13078

SEQ ID NO: 17157 - protein, 469 aa, Artificial Sequence; identical to SEQ ID NO: 16738
  neuraminidase__InfluenzaA__ACU13079

SEQ ID NO: 17158 - protein, 469 aa, Artificial Sequence; identical to SEQ ID NO: 16738
  neuraminidase__InfluenzaA__ACU13080

SEQ ID NO: 17159 - protein, 469 aa, Artificial Sequence; identical to SEQ ID NO: 16728
  neuraminidase__InfluenzaA__ACU13081

SEQ ID NO: 17160 - protein, 469 aa, Artificial Sequence; identical to SEQ ID NO: 16738
  neuraminidase__InfluenzaA__ACU13082

SEQ ID NO: 17161 - protein, 469 aa, Artificial Sequence; identical to SEQ ID NO: 16738
  neuraminidase__InfluenzaA__ACU13083

SEQ ID NO: 17162 - protein, 469 aa, Artificial Sequence
  neuraminidase__InfluenzaA__ACU13084
MNPNQKIITIGSVCMTIGMANLILQIGNIISIWISHSIQLGNQNQIETCNQSVITYENNTWVNQTYVNISNTNFAAGQSVVSMKLAGNSSLCPVGGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17163 - protein, 469 aa, Artificial Sequence; identical to SEQ ID NO: 16738
  neuraminidase__InfluenzaA__ACU16799

SEQ ID NO: 17164 - protein, 469 aa, Artificial Sequence; identical to SEQ ID NO: 16738
  neuraminidase__InfluenzaA__ACU16861

SEQ ID NO: 17165 - protein, 469 aa, Artificial Sequence; identical to SEQ ID NO: 16738
  neuraminidase__InfluenzaA__ACU16934

SEQ ID NO: 17166 - protein, 469 aa, Artificial Sequence; identical to SEQ ID NO: 16738
  neuraminidase__InfluenzaA__ACU16997

SEQ ID NO: 17167 - protein, 469 aa, Artificial Sequence; identical to SEQ ID NO: 16738
  neuraminidase__InfluenzaA__ACU17130

SEQ ID NO: 17168 - protein, 469 aa, Artificial Sequence; identical to SEQ ID NO: 16738
  neuraminidase__InfluenzaA__ACU17191

SEQ ID NO: 17169 - protein, 469 aa, Artificial Sequence
  neuraminidase__InfluenzaA__ACU17262
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17170 - protein, 469 aa, Artificial Sequence; identical to SEQ ID NO: 16738
  neuraminidase__InfluenzaA__ACU17325

SEQ ID NO: 17171 - protein, 469 aa, Artificial Sequence; identical to SEQ ID NO: 16738
  neuraminidase__InfluenzaA__ACU17393

SEQ ID NO: 17172 - protein, 469 aa, Artificial Sequence; identical to SEQ ID NO: 16738
  neuraminidase__InfluenzaA__ACU17454

SEQ ID NO: 17173 - protein, 469 aa, Artificial Sequence; identical to SEQ ID NO: 16738
  neuraminidase__InfluenzaA__ACU17524

SEQ ID NO: 17174 - protein, 469 aa, Artificial Sequence; identical to SEQ ID NO: 17092
  neuraminidase__InfluenzaA__ACU27043

SEQ ID NO: 17175 - protein, 470 aa, Artificial Sequence
  neuraminidase__InfluenzaA__ACU27415
MNPNQKIITIGSISIAIGIISLMLQIGNIISIWASHSIQTGSQNNTGICNQRIITYENSTWVNHTYVNINNTNVVAGEDKTSVTFAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17176 - protein, 470 aa, Artificial Sequence; identical to SEQ ID NO: 17175
  neuraminidase__InfluenzaA__ACU27416

SEQ ID NO: 17177 - protein, 469 aa, Artificial Sequence; identical to SEQ ID NO: 16728
  neuraminidase__InfluenzaA__ACU29961

SEQ ID NO: 17178 - protein, 469 aa, Artificial Sequence
  neuraminidase__InfluenzaA__ACU29971
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWSDGAELPFTIDK

SEQ ID NO: 17179 - protein, 469 aa, Artificial Sequence; identical to SEQ ID NO: 16738
  neuraminidase__InfluenzaA__ACU29981

SEQ ID NO: 17180 - protein, 469 aa, Artificial Sequence; identical to SEQ ID NO: 16738
  neuraminidase__InfluenzaA__ACU29991

SEQ ID NO: 17181 - protein, 469 aa, Artificial Sequence; identical to SEQ ID NO: 16738
  neuraminidase__InfluenzaA__ACU30001

SEQ ID NO: 17182 - protein, 469 aa, Artificial Sequence; identical to SEQ ID NO: 16738
  neuraminidase__InfluenzaA__ACU30021

SEQ ID NO: 17183 - protein, 469 aa, Artificial Sequence
  neuraminidase__InfluenzaA__ACU30085
MNPNQKIITIGSVCMTIGMANLILQIGNIISIWISHSIQLGNQNQIETCNQSVITYENNTWVNQTYVNISNTNFAAGQSVVSVKLMGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17184 - protein, 469 aa, Artificial Sequence; identical to SEQ ID NO: 17162
  neuraminidase__InfluenzaA__ACU30095

SEQ ID NO: 17185 - protein, 469 aa, Artificial Sequence; identical to SEQ ID NO: 16738
  neuraminidase__InfluenzaA__ACU30105

SEQ ID NO: 17186 - protein, 469 aa, Artificial Sequence; identical to SEQ ID NO: 16738
  neuraminidase__InfluenzaA__ACU30114

SEQ ID NO: 17187 - protein, 469 aa, Artificial Sequence; identical to SEQ ID NO: 16738
  neuraminidase__InfluenzaA__ACU30123

SEQ ID NO: 17188 - protein, 469 aa, Artificial Sequence
  neuraminidase__InfluenzaA__ACU31177
MNPNQKIITIGSVCMTIGMANLILQIGNIISIWISHLIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17189 - protein, 469 aa, Artificial Sequence; identical to SEQ ID NO: 16738
  neuraminidase__InfluenzaA__ACU31178

SEQ ID NO: 17190 - protein, 469 aa, Artificial Sequence; identical to SEQ ID NO: 16728
  neuraminidase__InfluenzaA__ACU31179

SEQ ID NO: 17191 - protein, 469 aa, Artificial Sequence; identical to SEQ ID NO: 16728
  neuraminidase__InfluenzaA__ACU31180

SEQ ID NO: 17192 - protein, 469 aa, Artificial Sequence; identical to SEQ ID NO: 16728
  neuraminidase__InfluenzaA__ACU31181

SEQ ID NO: 17193 - protein, 469 aa, Artificial Sequence; identical to SEQ ID NO: 16738
  neuraminidase__InfluenzaA__ACU31182

SEQ ID NO: 17194 - protein, 469 aa, Artificial Sequence; identical to SEQ ID NO: 16768
  neuraminidase__InfluenzaA__ACU31183

SEQ ID NO: 17195 - protein, 469 aa, Artificial Sequence; identical to SEQ ID NO: 16738
  neuraminidase__InfluenzaA__ACU31184

SEQ ID NO: 17196 - protein, 469 aa, Artificial Sequence; identical to SEQ ID NO: 16728
  neuraminidase__InfluenzaA__ACU31185

SEQ ID NO: 17197 - protein, 469 aa, Artificial Sequence; identical to SEQ ID NO: 16728
  neuraminidase__InfluenzaA__ACU31186

SEQ ID NO: 17198 - protein, 469 aa, Artificial Sequence; identical to SEQ ID NO: 16728
  neuraminidase__InfluenzaA__ACU31187

SEQ ID NO: 17199 - protein, 469 aa, Artificial Sequence; identical to SEQ ID NO: 16728
  neuraminidase__InfluenzaA__ACU31188

SEQ ID NO: 17200 - protein, 449 aa, Artificial Sequence
  neuraminidase__InfluenzaA__ACU46645
MNPNKKIITIGSICMVTGMVSLMLQIGNLISIWVSHSIHTGNQHKAEPISNTNLLTEKTVASVKLAGNSSLCPINGWAVYSKDNSIRIGSKGDVFVIREPFISCSHLECRTFFLTQGALLNDKHSNGTVKDRSPHRTLMSGPVGEAPSPYNSRFEYVAWSASACHDRTSRLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGAGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVNSDTVGWSWPDGAELPFTIDK

SEQ ID NO: 17201 - protein, 469 aa, Artificial Sequence
  neuraminidase__InfluenzaA__ACU56927
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIDKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17202 - protein, 469 aa, Artificial Sequence; identical to SEQ ID NO: 16893
  neuraminidase__InfluenzaA__ACU56934

SEQ ID NO: 17203 - protein, 469 aa, Artificial Sequence; identical to SEQ ID NO: 16738
  neuraminidase__InfluenzaA__ACU64791

SEQ ID NO: 17204 - protein, 469 aa, Artificial Sequence
  neuraminidase__InfluenzaA__ACU64811
MNPNQKIITIGSVCMTIGMANLILQIGNIISIWISHSIQLGNQNQIETCNQSVITYENNTWVNQTYVNISNTNFAAGQSMVSVKLAGNSSLCPVSGWAIYSKDNSVRIGSKGDVFIIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17205 - protein, 469 aa, Artificial Sequence; identical to SEQ ID NO: 16503
  neuraminidase__InfluenzaA__ACU79885

SEQ ID NO: 17206 - protein, 469 aa, Artificial Sequence; identical to SEQ ID NO: 14095
  neuraminidase__InfluenzaA__ACU79896

SEQ ID NO: 17207 - protein, 469 aa, Artificial Sequence; identical to SEQ ID NO: 14095
  neuraminidase__InfluenzaA__ACU79918

SEQ ID NO: 17208 - protein, 469 aa, Artificial Sequence; identical to SEQ ID NO: 14095
  neuraminidase__InfluenzaA__ACU79929

SEQ ID NO: 17209 - protein, 470 aa, Artificial Sequence
  neuraminidase__InfluenzaA__ACU79940
MNPNQKIITIGSISIVIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNSHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSVKQDVVAMTDWSGYSGSFVQHPELTGLDCIRPCFWVELVRGRPRENTTIWTSGSSISFCGVNSDTANWSWPDGAELPFTIDK

SEQ ID NO: 17210 - protein, 469 aa, Artificial Sequence
  neuraminidase__InfluenzaA__ACU79951
MNPNQKIITIGSVSLTIETVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDSRSGYETFKVIGGWSTPNSKSQVNRQVIVGNNNWSGYSGIFSVEGKSCINRCFYVELIRGRPQETRVWWTSNSIVVFCGTSGTYGTGSWPDGANINFMPI

SEQ ID NO: 17211 - protein, 469 aa, Artificial Sequence; identical to SEQ ID NO: 16603
  neuraminidase__InfluenzaA__ACU79973

SEQ ID NO: 17212 - protein, 470 aa, Artificial Sequence; identical to SEQ ID NO: 16632
  neuraminidase__InfluenzaA__ACU79984

SEQ ID NO: 17213 - protein, 469 aa, Artificial Sequence; identical to SEQ ID NO: 16599
  neuraminidase__InfluenzaA__ACU80006

SEQ ID NO: 17214 - protein, 469 aa, Artificial Sequence
  neuraminidase__InfluenzaA__ACU80017
MNTNQRIITIGTICLIVGIISLLLQIGNIILLWMSHSIQTGEKSHPKVCNQSVITYENNTWVNQTYVNISNTNIAAGQGVTPIILAGNSSLCPISGWAIYSKDNSIRIGSKGDIFVMREPFISCSHLECRTFFLTQGALLNDRHSNGTVKDRSPYRTLMSCPIGEAPSPYNSRFESVAWSASACHDGMGWLTIGISGPDNGAVAVLKYNGIITDTIKSWRNKILRTQESECVCINGSCFTIMTDGPSNGQASYKLFKMEKGKIIRSIELDAPNYHYEECSCYPDTGKVVCVCRDNWHASNRPWVSFDQNLDYQIGYICSGVFGDNPRSNDGKGNCGPVLSNGANGVKGFSFRYGNGVWIGRTKSISSRSGFEMIWDPNGWTETDSSFSMKQDIIALTDWSGYSGSFVQHPELTGMNCIRPCFWVELIRGQPKESTIWTSGSSISFCGVNSGTASWSWPDGADLPFTIDK

SEQ ID NO: 17215 - protein, 470 aa, Artificial Sequence; identical to SEQ ID NO: 16632
  neuraminidase__InfluenzaA__ACU80028

SEQ ID NO: 17216 - protein, 469 aa, Artificial Sequence; identical to SEQ ID NO: 16599
  neuraminidase__InfluenzaA__ACU80039

SEQ ID NO: 17217 - protein, 470 aa, Artificial Sequence; identical to SEQ ID NO: 16716
  neuraminidase__InfluenzaA__ACU80050

SEQ ID NO: 17218 - protein, 469 aa, Artificial Sequence; identical to SEQ ID NO: 17149
  neuraminidase__InfluenzaA__ACU80061

SEQ ID NO: 17219 - protein, 470 aa, Artificial Sequence; identical to SEQ ID NO: 16632
  neuraminidase__InfluenzaA__ACU80072

SEQ ID NO: 17220 - protein, 470 aa, Artificial Sequence; identical to SEQ ID NO: 16632
  neuraminidase__InfluenzaA__ACU80094

SEQ ID NO: 17221 - protein, 469 aa, Artificial Sequence; identical to SEQ ID NO: 16603
  neuraminidase__InfluenzaA__ACU80105

SEQ ID NO: 17222 - protein, 469 aa, Artificial Sequence; identical to SEQ ID NO: 16603
  neuraminidase__InfluenzaA__ACU80127

SEQ ID NO: 17223 - protein, 469 aa, Artificial Sequence; identical to SEQ ID NO: 16603
  neuraminidase__InfluenzaA__ACU80138

SEQ ID NO: 17224 - protein, 469 aa, Artificial Sequence; identical to SEQ ID NO: 16599
  neuraminidase__InfluenzaA__ACU80160

SEQ ID NO: 17225 - protein, 470 aa, Artificial Sequence; identical to SEQ ID NO: 16632
  neuraminidase__InfluenzaA__ACU80171

SEQ ID NO: 17226 - protein, 469 aa, Artificial Sequence; identical to SEQ ID NO: 16512
  neuraminidase__InfluenzaA__ACU80182

SEQ ID NO: 17227 - protein, 469 aa, Artificial Sequence
  neuraminidase__InfluenzaA__ACU80193
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGDRSGYSGIFSVEGKSCINRCFYVELIRGRKEETEVLWTSNSIVVFCGTSGTYGTGSWPDGADINLMPI

SEQ ID NO: 17228 - protein, 469 aa, Artificial Sequence; identical to SEQ ID NO: 16512
  neuraminidase__InfluenzaA__ACU80204

SEQ ID NO: 17229 - protein, 470 aa, Artificial Sequence
  neuraminidase__InfluenzaA__ACU80237
MNPNQKIITIGSISIAIGIISLMLQIGNIISIWASHSIQTGNQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17230 - protein, 469 aa, Artificial Sequence; identical to SEQ ID NO: 16603
  neuraminidase__InfluenzaA__ACU80248

SEQ ID NO: 17231 - protein, 469 aa, Artificial Sequence; identical to SEQ ID NO: 16603
  neuraminidase__InfluenzaA__ACU80259

SEQ ID NO: 17232 - protein, 470 aa, Artificial Sequence
  neuraminidase__InfluenzaA__ACU80270
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTSIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17233 - protein, 470 aa, Artificial Sequence
  neuraminidase__InfluenzaA__ACU80281
MNQNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17234 - protein, 469 aa, Artificial Sequence
  neuraminidase__InfluenzaA__ACU80303
MNPNQKIITIGSVSLTISTICFFMQIAILITTVTLHFKQYEFNSSPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGNGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 17235 - protein, 469 aa, Artificial Sequence; identical to SEQ ID NO: 16603
  neuraminidase__InfluenzaA__ACU80314

SEQ ID NO: 17236 - protein, 469 aa, Artificial Sequence; identical to SEQ ID NO: 16603
  neuraminidase__InfluenzaA__ACU80325

SEQ ID NO: 17237 - protein, 469 aa, Artificial Sequence; identical to SEQ ID NO: 16599
  neuraminidase__InfluenzaA__ACU80336

SEQ ID NO: 17238 - protein, 469 aa, Artificial Sequence; identical to SEQ ID NO: 16603
  neuraminidase__InfluenzaA__ACU80347

SEQ ID NO: 17239 - protein, 469 aa, Artificial Sequence; identical to SEQ ID NO: 16603
  neuraminidase__InfluenzaA__ACU80358

SEQ ID NO: 17240 - protein, 469 aa, Artificial Sequence; identical to SEQ ID NO: 16603
  neuraminidase__InfluenzaA__ACU80369

SEQ ID NO: 17241 - protein, 469 aa, Artificial Sequence; identical to SEQ ID NO: 16603
  neuraminidase__InfluenzaA__ACU80380

SEQ ID NO: 17242 - protein, 469 aa, Artificial Sequence
  neuraminidase__InfluenzaA__ACU80391
MNPNQKIITIGSVSLTISTICFFMQIAILITTVTLHFKQYEFNSSPNNQVMLCEPTIIERNITEIVYLTNTIIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 17243 - protein, 469 aa, Artificial Sequence; identical to SEQ ID NO: 16599
  neuraminidase__InfluenzaA__ACU80402

SEQ ID NO: 17244 - protein, 470 aa, Artificial Sequence; identical to SEQ ID NO: 16632
  neuraminidase__InfluenzaA__ACU80413

SEQ ID NO: 17245 - protein, 469 aa, Artificial Sequence; identical to SEQ ID NO: 16603
  neuraminidase__InfluenzaA__ACU80427

SEQ ID NO: 17246 - protein, 469 aa, Artificial Sequence; identical to SEQ ID NO: 16603
  neuraminidase__InfluenzaA__ACU80438

SEQ ID NO: 17247 - protein, 469 aa, Artificial Sequence; identical to SEQ ID NO: 16599
  neuraminidase__InfluenzaA__ACU80461

SEQ ID NO: 17248 - protein, 469 aa, Artificial Sequence; identical to SEQ ID NO: 16603
  neuraminidase__InfluenzaA__ACU80603

SEQ ID NO: 17249 - protein, 469 aa, Artificial Sequence; identical to SEQ ID NO: 16603
  neuraminidase__InfluenzaA__ACU80614

SEQ ID NO: 17250 - protein, 469 aa, Artificial Sequence; identical to SEQ ID NO: 16603
  neuraminidase__InfluenzaA__ACU80625

SEQ ID NO: 17251 - protein, 469 aa, Artificial Sequence; identical to SEQ ID NO: 16599
  neuraminidase__InfluenzaA__ACU80636

SEQ ID NO: 17252 - protein, 469 aa, Artificial Sequence
  neuraminidase__InfluenzaA__ACU80647
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGDRSGYSGIFSVEGKSCINRCFYVELIRGRKEETEVLWTSNSIVVFCGTSGTYGTGSWPDGADINLMPI

SEQ ID NO: 17253 - protein, 469 aa, Artificial Sequence
  neuraminidase__InfluenzaA__ACU80658
MNPNQKIITIGSVSLTISTICFFMQIAILITTVTLHFKQYEFNSPPNNQVMLCEPKIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 17254 - protein, 469 aa, Artificial Sequence; identical to SEQ ID NO: 16512
  neuraminidase__InfluenzaA__ACU80669

SEQ ID NO: 17255 - protein, 469 aa, Artificial Sequence; identical to SEQ ID NO: 16599
  neuraminidase__InfluenzaA__ACU80691

SEQ ID NO: 17256 - protein, 469 aa, Artificial Sequence; identical to SEQ ID NO: 16603
  neuraminidase__InfluenzaA__ACU80702

SEQ ID NO: 17257 - protein, 469 aa, Artificial Sequence; identical to SEQ ID NO: 16603
  neuraminidase__InfluenzaA__ACU80713

SEQ ID NO: 17258 - protein, 469 aa, Artificial Sequence; identical to SEQ ID NO: 16599
  neuraminidase__InfluenzaA__ACU80724

SEQ ID NO: 17259 - protein, 469 aa, Artificial Sequence; identical to SEQ ID NO: 16512
  neuraminidase__InfluenzaA__ACU80735

SEQ ID NO: 17260 - protein, 469 aa, Artificial Sequence; identical to SEQ ID NO: 16599
  neuraminidase__InfluenzaA__ACU80746

SEQ ID NO: 17261 - protein, 469 aa, Artificial Sequence
  neuraminidase__InfluenzaA__ACU80757
MNPNQKIITIGSVSLTISTICFFMQIAILITTVTLHFKQYEFNSPPNNQVMLCEPTIIERNITEVVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 17262 - protein, 469 aa, Artificial Sequence; identical to SEQ ID NO: 17227
  neuraminidase__InfluenzaA__ACU80768

SEQ ID NO: 17263 - protein, 469 aa, Artificial Sequence; identical to SEQ ID NO: 16599
  neuraminidase__InfluenzaA__ACU80779

SEQ ID NO: 17264 - protein, 469 aa, Artificial Sequence; identical to SEQ ID NO: 16512
  neuraminidase__InfluenzaA__ACU80790

SEQ ID NO: 17265 - protein, 469 aa, Artificial Sequence; identical to SEQ ID NO: 16599
  neuraminidase__InfluenzaA__ACU80801

SEQ ID NO: 17266 - protein, 469 aa, Artificial Sequence
  neuraminidase__InfluenzaA__ACU81106
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNSSGYSGIFSVEGKSCINRCFYVELIRGRKEETEVLWTSNSIVVFCGTSGTYGTGSWPDGADINLMPI

SEQ ID NO: 17267 - protein, 469 aa, Artificial Sequence; identical to SEQ ID NO: 16893
  neuraminidase__InfluenzaA__ACU87265

SEQ ID NO: 17268 - protein, 469 aa, Artificial Sequence; identical to SEQ ID NO: 16738
  neuraminidase__InfluenzaA__ACU87273

SEQ ID NO: 17269 - protein, 469 aa, Artificial Sequence; identical to SEQ ID NO: 16738
  neuraminidase__InfluenzaA__ACV04231

SEQ ID NO: 17270 - protein, 469 aa, Artificial Sequence; identical to SEQ ID NO: 16738
  neuraminidase__InfluenzaA__ACV04241

SEQ ID NO: 17271 - protein, 469 aa, Artificial Sequence; identical to SEQ ID NO: 16738
  neuraminidase__InfluenzaA__ACV04251

SEQ ID NO: 17272 - protein, 469 aa, Artificial Sequence; identical to SEQ ID NO: 16738
  neuraminidase__InfluenzaA__ACV04261

SEQ ID NO: 17273 - protein, 469 aa, Artificial Sequence; identical to SEQ ID NO: 16738
  neuraminidase__InfluenzaA__ACV04271

SEQ ID NO: 17274 - protein, 469 aa, Artificial Sequence
  neuraminidase__InfluenzaA__ACV04281
MNPNQKIITIGSVCMTIGMANLILQIGNIISIWISHSIQLGNQNQIETCNQSVITYENNTWVNQTYVNIGNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17275 - protein, 469 aa, Artificial Sequence; identical to SEQ ID NO: 16738
  neuraminidase__InfluenzaA__ACV04291

SEQ ID NO: 17276 - protein, 469 aa, Artificial Sequence; identical to SEQ ID NO: 16738
  neuraminidase__InfluenzaA__ACV04301

SEQ ID NO: 17277 - protein, 469 aa, Artificial Sequence; identical to SEQ ID NO: 16738
  neuraminidase__InfluenzaA__ACV04321

SEQ ID NO: 17278 - protein, 469 aa, Artificial Sequence; identical to SEQ ID NO: 16738
  neuraminidase__InfluenzaA__ACV04331

SEQ ID NO: 17279 - protein, 469 aa, Artificial Sequence; identical to SEQ ID NO: 16738
  neuraminidase__InfluenzaA__ACV04341

SEQ ID NO: 17280 - protein, 469 aa, Artificial Sequence; identical to SEQ ID NO: 16738
  neuraminidase__InfluenzaA__ACV04351

SEQ ID NO: 17281 - protein, 469 aa, Artificial Sequence; identical to SEQ ID NO: 16738
  neuraminidase__InfluenzaA__ACV04361

SEQ ID NO: 17282 - protein, 469 aa, Artificial Sequence; identical to SEQ ID NO: 16738
  neuraminidase__InfluenzaA__ACV04371

SEQ ID NO: 17283 - protein, 469 aa, Artificial Sequence; identical to SEQ ID NO: 16738
  neuraminidase__InfluenzaA__ACV04381

SEQ ID NO: 17284 - protein, 469 aa, Artificial Sequence; identical to SEQ ID NO: 16738
  neuraminidase__InfluenzaA__ACV04391

SEQ ID NO: 17285 - protein, 469 aa, Artificial Sequence; identical to SEQ ID NO: 16738
  neuraminidase__InfluenzaA__ACV04401

SEQ ID NO: 17286 - protein, 469 aa, Artificial Sequence; identical to SEQ ID NO: 16728
  neuraminidase__InfluenzaA__ACV04411

SEQ ID NO: 17287 - protein, 469 aa, Artificial Sequence; identical to SEQ ID NO: 16738
  neuraminidase__InfluenzaA__ACV04492

SEQ ID NO: 17288 - protein, 469 aa, Artificial Sequence; identical to SEQ ID NO: 16738
  neuraminidase__InfluenzaA__ACV04502

SEQ ID NO: 17289 - protein, 469 aa, Artificial Sequence; identical to SEQ ID NO: 16728
  neuraminidase__InfluenzaA__ACV04512

SEQ ID NO: 17290 - protein, 469 aa, Artificial Sequence
  neuraminidase__InfluenzaA__ACV04522
MNPNQKIITIGSVCMTIGMANLILQIGNIISIWISHSIQLGNQNQIETCNQSVITYENNTWVNQTYVNISNTNFAAGKSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17291 - protein, 469 aa, Artificial Sequence; identical to SEQ ID NO: 16738
  neuraminidase__InfluenzaA__ACV04532

SEQ ID NO: 17292 - protein, 469 aa, Artificial Sequence; identical to SEQ ID NO: 16738
  neuraminidase__InfluenzaA__ACV04542

SEQ ID NO: 17293 - protein, 469 aa, Artificial Sequence; identical to SEQ ID NO: 16738
  neuraminidase__InfluenzaA__ACV04552

SEQ ID NO: 17294 - protein, 469 aa, Artificial Sequence; identical to SEQ ID NO: 16738
  neuraminidase__InfluenzaA__ACV04562

SEQ ID NO: 17295 - protein, 469 aa, Artificial Sequence; identical to SEQ ID NO: 16728
  neuraminidase__InfluenzaA__ACV04572

SEQ ID NO: 17296 - protein, 469 aa, Artificial Sequence; identical to SEQ ID NO: 16738
  neuraminidase__InfluenzaA__ACV04582

SEQ ID NO: 17297 - protein, 469 aa, Artificial Sequence
  neuraminidase__InfluenzaA__ACV04758
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPSECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17298 - protein, 469 aa, Artificial Sequence; identical to SEQ ID NO: 16728
  neuraminidase__InfluenzaA__ACV33087

SEQ ID NO: 17299 - protein, 469 aa, Artificial Sequence; identical to SEQ ID NO: 16738
  neuraminidase__InfluenzaA__ACV33107

SEQ ID NO: 17300 - protein, 469 aa, Artificial Sequence; identical to SEQ ID NO: 16738
  neuraminidase__InfluenzaA__ACV33117

SEQ ID NO: 17301 - protein, 469 aa, Artificial Sequence; identical to SEQ ID NO: 16738
  neuraminidase__InfluenzaA__ACV33127

SEQ ID NO: 17302 - protein, 469 aa, Artificial Sequence; identical to SEQ ID NO: 16738
  neuraminidase__InfluenzaA__ACV33137

SEQ ID NO: 17303 - protein, 469 aa, Artificial Sequence; identical to SEQ ID NO: 16738
  neuraminidase__InfluenzaA__ACV33147

SEQ ID NO: 17304 - protein, 469 aa, Artificial Sequence
  neuraminidase__InfluenzaA__ACV33157
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPVGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17305 - protein, 469 aa, Artificial Sequence
  neuraminidase__InfluenzaA__ACV33167
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVDWSWPDGAELPFTIDK

SEQ ID NO: 17306 - protein, 469 aa, Artificial Sequence; identical to SEQ ID NO: 16738
  neuraminidase__InfluenzaA__ACV33177

SEQ ID NO: 17307 - protein, 469 aa, Artificial Sequence
  neuraminidase__InfluenzaA__ACV41993
MNPNQKIITIGSVCMTIGMANLILQIGNIISIWISHSIQLGNQNQIEICNQSVITYENNTWVNQTYVNISNTNFAAGQSVVSVKLAGNSSLCPVGGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17308 - protein, 469 aa, Artificial Sequence; identical to SEQ ID NO: 16738
  neuraminidase__InfluenzaA__ACV42010

SEQ ID NO: 17309 - protein, 469 aa, Artificial Sequence; identical to SEQ ID NO: 16738
  neuraminidase__InfluenzaA__ACV42020

SEQ ID NO: 17310 - protein, 469 aa, Artificial Sequence; identical to SEQ ID NO: 16503
  neuraminidase__InfluenzaA__ACV49504

SEQ ID NO: 17311 - protein, 453 aa, Artificial Sequence
  neuraminidase__InfluenzaA__ACV49537
MNPNQKIITIGSICMVVGIISLILQIGNIISIWISHSIQTGNQNHTGICNQGIITYNVVAGQDSTSVILTGNSSLCPIRGWAIHSKDNGIRIGSKGDVFVIREPFISCSHLECRTFFLTQGALLNDKHSNGAVKDRSPYRALMSCPVGEAPSPYNSRFESVAWSASACHDGMGWLTIGISGPDNGAVAVLKYNGIITETIKSWRKKILRTQESECTCVNGSCFTIMTDGPSDGLASYKIFKIEKGKVTKSIELNAPNSHYEECSCYPDTGKVMCVCRDNWHGSNRPWVSFDQNLDYQIGYICSGVFGDNPRPKDGTGSCGPVSADGANGVKGFSYRYGNGVWIGRTKSDSSRHGFEMIWDPNGWTETDSRFSVRQDVVAMTDRSGYSGSFVQHPELTGLDCMRPCFWVELIRGRPEEKTIWTSGSIISFCGVNSDTVDWSWPDGAELPFTIDK

SEQ ID NO: 17312 - protein, 453 aa, Artificial Sequence
  neuraminidase__InfluenzaA__ACV49559
MNPNQKIITIGSICMVVGIISLILQIGNIISIWISHSIQAGSSTWVNQTYVNISNTNVVAGQDATSVILTGNSSLCPIRGWAIYSKDNGIRIGSKGDIFVIREPFISCSHLECRAFFLTQGALLNDKHSNGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSDGPASYKIFKIEKGKVTKSIELDAPNSHYEECSCYPDTGKVMCVCRDNWHGSNRPWVSFDQNLDYQIGYICSGVFGDTPRPKDGTGSCGPVSVDGANGVKGFSYRYGDGVWIGRTKSQSSRHGFEMIWDPNGWTETDSRFSVRQDVVAITDWSGYSGSFVQHPELTGLDCMRPCFWVELIRGQPKEKTIWTSGSSISFCGVNSDTVDWSWPDGAELPFTIDK

SEQ ID NO: 17313 - protein, 464 aa, Artificial Sequence
  neuraminidase__InfluenzaA__ACV49570
MNPNQKIITIGSICMVVGIISLILQIGNIVSIWISHSIQTGNQNHTGTCDQSIITYKNSTWVNQTYVNVVAGKDTTSVILAGNSSLCPIRGWAIYSKDNGVRIGSKGDVFVIREPFISCSHLECRTFFLTQGALLNDKHSNGTVKDRSPYRALMSCPVGEAPSPYNSRFESVAWSASACHDGMGWLTIGISGPDDGAVAVLKYNGIITETIKSWRKEILRTQESECVCVNGSCFTIMTDGPSGGPASYKIFKIEKGKVTKSIELDAPNSHYEECSCYPDTSKVMCVCRDNWHGSNRPWVSFDQNLDYQMGYICSGVFGDNPRPKDGKGSCGPVYVDGANGVKGFSYKYGNGVWIGRTKSNSSRQGFEMIWDPNGWTETDSNFFTKQDVVAVTDWSGYSGSFVQHPELTGLDCMRPCFWVELIRGRPKENTIWTSGSSISFCGVNSDTVDWSWPDGAELPFTIDK

SEQ ID NO: 17314 - protein, 469 aa, Artificial Sequence; identical to SEQ ID NO: 16404
  neuraminidase__InfluenzaA__ACV49581

SEQ ID NO: 17315 - protein, 469 aa, Artificial Sequence; identical to SEQ ID NO: 16404
  neuraminidase__InfluenzaA__ACV49592

SEQ ID NO: 17316 - protein, 469 aa, Artificial Sequence
  neuraminidase__InfluenzaA__ACV49603
MNPNQKIITIGSVSLTIETVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 17317 - protein, 469 aa, Artificial Sequence
  neuraminidase__InfluenzaA__ACV49625
MNPNQKTITIGSVSLTIETVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTRGPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 17318 - protein, 469 aa, Artificial Sequence; identical to SEQ ID NO: 16456
  neuraminidase__InfluenzaA__ACV49647

SEQ ID NO: 17319 - protein, 470 aa, Artificial Sequence
  neuraminidase__InfluenzaA__ACV49669
MNPNQKIITIGSICMAIGIISLILQIGNIVSIWISHSIQTGSQNYTGICNQRIITYENSTWVNQTYVNINNTNVVAGQDTTSVTLAGNSSLCPISGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPNNGPASYKIFKIEKGKITKSIELDAPNSHYEECSCYPDAGTVMCVCRDNWHGSNRPWVSFNQNLDYQIGYICSGVFGDNPRPKDGKGSCGPVTVDGADGVKGFSYRYGNGVWIGRTKSNSSRRGFEMIWDPNGWTDTDSKFLVKQDVVAMTDWSGYSGSFVQHPELTGLDCMRPCFWVELIRGRPRENTTIWTSGSSISFCGVNGDTANWSWPDGAELPFTIDK

SEQ ID NO: 17320 - protein, 470 aa, Artificial Sequence
  neuraminidase__InfluenzaA__ACV49679
MNPNQKIITIGSISIAIGIISLMLQIGSIISIWASHSIRTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17321 - protein, 469 aa, Artificial Sequence
  neuraminidase__InfluenzaA__ACV53442
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17322 - protein, 469 aa, Artificial Sequence; identical to SEQ ID NO: 17105
  neuraminidase__InfluenzaA__ACV53452

SEQ ID NO: 17323 - protein, 469 aa, Artificial Sequence; identical to SEQ ID NO: 16728
  neuraminidase__InfluenzaA__ACV53462

SEQ ID NO: 17324 - protein, 469 aa, Artificial Sequence; identical to SEQ ID NO: 16738
  neuraminidase__InfluenzaA__ACV53472

SEQ ID NO: 17325 - protein, 469 aa, Artificial Sequence
  neuraminidase__InfluenzaA__ACV53482
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSGEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTATDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17326 - protein, 469 aa, Artificial Sequence
  neuraminidase__InfluenzaA__ACV53492
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKAGSCGPVSSNGANGVKGFSFKYGNGVWIGRTKSISSRNGFEMIWDPNGWTETDNNFLIKQDIVGINEWSGYSGSFVQHPELTGLDCIRPCFWVELIRGRPKENTIWTSGSSISFCGVNSDTVGWSWPDGAELPFTIDK

SEQ ID NO: 17327 - protein, 469 aa, Artificial Sequence
  neuraminidase__InfluenzaA__ACV53502
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKAGSCGPVSSNGANGVKGFSFKYGNGVWIGRTKSISSRNGFEMIWDPNGWTGTDNNFLIKQDIVGINEWSGYSGSFVQHPELTGLDCIRPCFWVELIRGRPKENTIWTSGSSISFCGVNSDTVGWSWPDGAELPFTIDK

SEQ ID NO: 17328 - protein, 469 aa, Artificial Sequence
  neuraminidase__InfluenzaA__ACV53891
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNKILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMICDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17329 - protein, 469 aa, Artificial Sequence
  neuraminidase__InfluenzaA__ACV53901
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSRSFVQHPELTGLDCIRPCFWVELIRGRPKENTIWTSGSSISFCGVNSDTVGWSWPDGAELPFTIDK

SEQ ID NO: 17330 - protein, 469 aa, Artificial Sequence; identical to SEQ ID NO: 16738
  neuraminidase__InfluenzaA__ACV53911

SEQ ID NO: 17331 - protein, 469 aa, Artificial Sequence; identical to SEQ ID NO: 16728
  neuraminidase__InfluenzaA__ACV67088

SEQ ID NO: 17332 - protein, 469 aa, Artificial Sequence; identical to SEQ ID NO: 16738
  neuraminidase__InfluenzaA__ACV67168

SEQ ID NO: 17333 - protein, 469 aa, Artificial Sequence; identical to SEQ ID NO: 16728
  neuraminidase__InfluenzaA__ACV67169

SEQ ID NO: 17334 - protein, 469 aa, Artificial Sequence; identical to SEQ ID NO: 16738
  neuraminidase__InfluenzaA__ACV67171

SEQ ID NO: 17335 - protein, 469 aa, Artificial Sequence; identical to SEQ ID NO: 16738
  neuraminidase__InfluenzaA__ACV67172

SEQ ID NO: 17336 - protein, 469 aa, Artificial Sequence; identical to SEQ ID NO: 16768
  neuraminidase__InfluenzaA__ACV67173

SEQ ID NO: 17337 - protein, 469 aa, Artificial Sequence; identical to SEQ ID NO: 16728
  neuraminidase__InfluenzaA__ACV67174

SEQ ID NO: 17338 - protein, 469 aa, Artificial Sequence
  neuraminidase__InfluenzaA__ACV67175
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGSNGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17339 - protein, 469 aa, Artificial Sequence; identical to SEQ ID NO: 16738
  neuraminidase__InfluenzaA__ACV67176

SEQ ID NO: 17340 - protein, 469 aa, Artificial Sequence; identical to SEQ ID NO: 16728
  neuraminidase__InfluenzaA__ACV67177

SEQ ID NO: 17341 - protein, 469 aa, Artificial Sequence; identical to SEQ ID NO: 16738
  neuraminidase__InfluenzaA__ACV67178

SEQ ID NO: 17342 - protein, 469 aa, Artificial Sequence; identical to SEQ ID NO: 16738
  neuraminidase__InfluenzaA__ACV67179

SEQ ID NO: 17343 - protein, 469 aa, Artificial Sequence
  neuraminidase__InfluenzaA__ACV67180
MNPNQKIITIGSVCMTIGMANLILQIGNIISIWISHSIQLGNQNQIETCNQSVITYENNTWVNQTYVNISNTNFAAGQPVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17344 - protein, 469 aa, Artificial Sequence
  neuraminidase__InfluenzaA__ACV67181
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFIIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIIKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17345 - protein, 469 aa, Artificial Sequence; identical to SEQ ID NO: 17162
  neuraminidase__InfluenzaA__ACV67182

SEQ ID NO: 17346 - protein, 469 aa, Artificial Sequence
  neuraminidase__InfluenzaA__ACV67183
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSNEITCVCRDNWHGSNRPWVSFNQNLEYQIGYICSGIFGDNPRPNDKTGSCGPVSSNGANGVKGFSFKYGNGVWIGRTKSINSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17347 - protein, 469 aa, Artificial Sequence; identical to SEQ ID NO: 16738
  neuraminidase__InfluenzaA__ACV67184

SEQ ID NO: 17348 - protein, 469 aa, Artificial Sequence; identical to SEQ ID NO: 16728
  neuraminidase__InfluenzaA__ACV67186

SEQ ID NO: 17349 - protein, 469 aa, Artificial Sequence; identical to SEQ ID NO: 16738
  neuraminidase__InfluenzaA__ACV67187

SEQ ID NO: 17350 - protein, 469 aa, Artificial Sequence; identical to SEQ ID NO: 16738
  neuraminidase__InfluenzaA__ACV67188

SEQ ID NO: 17351 - protein, 469 aa, Artificial Sequence; identical to SEQ ID NO: 16768
  neuraminidase__InfluenzaA__ACV67189

SEQ ID NO: 17352 - protein, 469 aa, Artificial Sequence; identical to SEQ ID NO: 16768
  neuraminidase__InfluenzaA__ACV67190

SEQ ID NO: 17353 - protein, 469 aa, Artificial Sequence; identical to SEQ ID NO: 16728
  neuraminidase__InfluenzaA__ACV67191

SEQ ID NO: 17354 - protein, 469 aa, Artificial Sequence; identical to SEQ ID NO: 16768
  neuraminidase__InfluenzaA__ACV67192

SEQ ID NO: 17355 - protein, 469 aa, Artificial Sequence; identical to SEQ ID NO: 16768
  neuraminidase__InfluenzaA__ACV67193

SEQ ID NO: 17356 - protein, 469 aa, Artificial Sequence; identical to SEQ ID NO: 16738
  neuraminidase__InfluenzaA__ACV67194

SEQ ID NO: 17357 - protein, 469 aa, Artificial Sequence; identical to SEQ ID NO: 16738
  neuraminidase__InfluenzaA__ACV67195

SEQ ID NO: 17358 - protein, 469 aa, Artificial Sequence; identical to SEQ ID NO: 16738
  neuraminidase__InfluenzaA__ACV67196

SEQ ID NO: 17359 - protein, 469 aa, Artificial Sequence; identical to SEQ ID NO: 16728
  neuraminidase__InfluenzaA__ACV67197

SEQ ID NO: 17360 - protein, 469 aa, Artificial Sequence; identical to SEQ ID NO: 16728
  neuraminidase__InfluenzaA__ACV67199

SEQ ID NO: 17361 - protein, 469 aa, Artificial Sequence; identical to SEQ ID NO: 16728
  neuraminidase__InfluenzaA__ACV67200

SEQ ID NO: 17362 - protein, 469 aa, Artificial Sequence; identical to SEQ ID NO: 16728
  neuraminidase__InfluenzaA__ACV67201

SEQ ID NO: 17363 - protein, 469 aa, Artificial Sequence; identical to SEQ ID NO: 16728
  neuraminidase__InfluenzaA__ACV67202

SEQ ID NO: 17364 - protein, 469 aa, Artificial Sequence; identical to SEQ ID NO: 16738
  neuraminidase__InfluenzaA__ACV67203

SEQ ID NO: 17365 - protein, 469 aa, Artificial Sequence; identical to SEQ ID NO: 16738
  neuraminidase__InfluenzaA__ACV67204

SEQ ID NO: 17366 - protein, 469 aa, Artificial Sequence; identical to SEQ ID NO: 16738
  neuraminidase__InfluenzaA__ACV67205

SEQ ID NO: 17367 - protein, 469 aa, Artificial Sequence
  neuraminidase__InfluenzaA__ACV67206
MNPNQKIITIGSVCMTIGMANLILQIGNIISIWISHSIQLGNQNQIETCNQSVITYENNTWVNQTYVNISNTNFAAGQSMVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17368 - protein, 469 aa, Artificial Sequence; identical to SEQ ID NO: 16728
  neuraminidase__InfluenzaA__ACV67207

SEQ ID NO: 17369 - protein, 469 aa, Artificial Sequence; identical to SEQ ID NO: 16738
  neuraminidase__InfluenzaA__ACV67208

SEQ ID NO: 17370 - protein, 469 aa, Artificial Sequence; identical to SEQ ID NO: 16728
  neuraminidase__InfluenzaA__ACV67210

SEQ ID NO: 17371 - protein, 469 aa, Artificial Sequence; identical to SEQ ID NO: 16738
  neuraminidase__InfluenzaA__ACV67211

SEQ ID NO: 17372 - protein, 469 aa, Artificial Sequence; identical to SEQ ID NO: 16738
  neuraminidase__InfluenzaA__ACV70076

SEQ ID NO: 17373 - protein, 469 aa, Artificial Sequence
  neuraminidase__InfluenzaA__ACV70086
MNPNQKIITIGSVCMTIGMANLILQIGNIISIWISHSIQLGNQNQIETCNQSIITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17374 - protein, 469 aa, Artificial Sequence
  neuraminidase__InfluenzaA__ACV70096
MNPNQKIITIGSVCMTIGMANLILQIGNIISIWISHSIQLGNQNQIETCNQSVITYENNTWVNQTYVNISNTNFTAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17375 - protein, 469 aa, Artificial Sequence; identical to SEQ ID NO: 16738
  neuraminidase__InfluenzaA__ACV70106

SEQ ID NO: 17376 - protein, 469 aa, Artificial Sequence; identical to SEQ ID NO: 16738
  neuraminidase__InfluenzaA__ACV70116

SEQ ID NO: 17377 - protein, 469 aa, Artificial Sequence; identical to SEQ ID NO: 16738
  neuraminidase__InfluenzaA__ACV70126

SEQ ID NO: 17378 - protein, 469 aa, Artificial Sequence; identical to SEQ ID NO: 16738
  neuraminidase__InfluenzaA__ACV70157

SEQ ID NO: 17379 - protein, 469 aa, Artificial Sequence; identical to SEQ ID NO: 16728
  neuraminidase__InfluenzaA__ACV70167

SEQ ID NO: 17380 - protein, 469 aa, Artificial Sequence; identical to SEQ ID NO: 16738
  neuraminidase__InfluenzaA__ACV70177

SEQ ID NO: 17381 - protein, 469 aa, Artificial Sequence; identical to SEQ ID NO: 16738
  neuraminidase__InfluenzaA__ACV70187

SEQ ID NO: 17382 - protein, 469 aa, Artificial Sequence; identical to SEQ ID NO: 16738
  neuraminidase__InfluenzaA__ACV70197

SEQ ID NO: 17383 - protein, 469 aa, Artificial Sequence; identical to SEQ ID NO: 16738
  neuraminidase__InfluenzaA__ACV70207

SEQ ID NO: 17384 - protein, 469 aa, Artificial Sequence
  neuraminidase__InfluenzaA__ACV70217
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSHLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17385 - protein, 469 aa, Artificial Sequence; identical to SEQ ID NO: 16738
  neuraminidase__InfluenzaA__ACV70227

SEQ ID NO: 17386 - protein, 469 aa, Artificial Sequence; identical to SEQ ID NO: 16738
  neuraminidase__InfluenzaA__ACV70237

SEQ ID NO: 17387 - protein, 469 aa, Artificial Sequence; identical to SEQ ID NO: 16738
  neuraminidase__InfluenzaA__ACV70247

SEQ ID NO: 17388 - protein, 469 aa, Artificial Sequence; identical to SEQ ID NO: 16738
  neuraminidase__InfluenzaA__ACV70257

SEQ ID NO: 17389 - protein, 469 aa, Artificial Sequence; identical to SEQ ID NO: 16738
  neuraminidase__InfluenzaA__ACV70267

SEQ ID NO: 17390 - protein, 469 aa, Artificial Sequence; identical to SEQ ID NO: 16738
  neuraminidase__InfluenzaA__ACV70277

SEQ ID NO: 17391 - protein, 469 aa, Artificial Sequence; identical to SEQ ID NO: 16738
  neuraminidase__InfluenzaA__ACV70287

SEQ ID NO: 17392 - protein, 469 aa, Artificial Sequence; identical to SEQ ID NO: 16738
  neuraminidase__InfluenzaA__ACV70297

SEQ ID NO: 17393 - protein, 469 aa, Artificial Sequence; identical to SEQ ID NO: 16738
  neuraminidase__InfluenzaA__ACV70307

SEQ ID NO: 17394 - protein, 469 aa, Artificial Sequence; identical to SEQ ID NO: 16728
  neuraminidase__InfluenzaA__ACV70317

SEQ ID NO: 17395 - protein, 469 aa, Artificial Sequence; identical to SEQ ID NO: 16738
  neuraminidase__InfluenzaA__ACV70327

SEQ ID NO: 17396 - protein, 469 aa, Artificial Sequence; identical to SEQ ID NO: 16738
  neuraminidase__InfluenzaA__ACV70337

SEQ ID NO: 17397 - protein, 469 aa, Artificial Sequence; identical to SEQ ID NO: 16738
  neuraminidase__InfluenzaA__ACV70347

SEQ ID NO: 17398 - protein, 469 aa, Artificial Sequence; identical to SEQ ID NO: 16738
  neuraminidase__InfluenzaA__ACV70357

SEQ ID NO: 17399 - protein, 469 aa, Artificial Sequence; identical to SEQ ID NO: 16738
  neuraminidase__InfluenzaA__ACV70367

SEQ ID NO: 17400 - protein, 469 aa, Artificial Sequence; identical to SEQ ID NO: 16738
  neuraminidase__InfluenzaA__ACV70377

SEQ ID NO: 17401 - protein, 469 aa, Artificial Sequence; identical to SEQ ID NO: 16738
  neuraminidase__InfluenzaA__ACV70387

SEQ ID NO: 17402 - protein, 469 aa, Artificial Sequence; identical to SEQ ID NO: 16738
  neuraminidase__InfluenzaA__ACV70397

SEQ ID NO: 17403 - protein, 469 aa, Artificial Sequence; identical to SEQ ID NO: 16738
  neuraminidase__InfluenzaA__ACV70407

SEQ ID NO: 17404 - protein, 469 aa, Artificial Sequence; identical to SEQ ID NO: 16728
  neuraminidase__InfluenzaA__ACV70417

SEQ ID NO: 17405 - protein, 469 aa, Artificial Sequence; identical to SEQ ID NO: 16738
  neuraminidase__InfluenzaA__ACV70427

SEQ ID NO: 17406 - protein, 469 aa, Artificial Sequence; identical to SEQ ID NO: 16738
  neuraminidase__InfluenzaA__ACV70437

SEQ ID NO: 17407 - protein, 469 aa, Artificial Sequence; identical to SEQ ID NO: 16738
  neuraminidase__InfluenzaA__ACV70447

SEQ ID NO: 17408 - protein, 469 aa, Artificial Sequence; identical to SEQ ID NO: 16738
  neuraminidase__InfluenzaA__ACV70457

SEQ ID NO: 17409 - protein, 469 aa, Artificial Sequence; identical to SEQ ID NO: 16738
  neuraminidase__InfluenzaA__ACV70467

SEQ ID NO: 17410 - protein, 469 aa, Artificial Sequence; identical to SEQ ID NO: 16738
  neuraminidase__InfluenzaA__ACV70477

SEQ ID NO: 17411 - protein, 469 aa, Artificial Sequence; identical to SEQ ID NO: 16738
  neuraminidase__InfluenzaA__ACV70487

SEQ ID NO: 17412 - protein, 469 aa, Artificial Sequence; identical to SEQ ID NO: 16738
  neuraminidase__InfluenzaA__ACV70497

SEQ ID NO: 17413 - protein, 469 aa, Artificial Sequence; identical to SEQ ID NO: 16738
  neuraminidase__InfluenzaA__ACV70507

SEQ ID NO: 17414 - protein, 469 aa, Artificial Sequence; identical to SEQ ID NO: 16738
  neuraminidase__InfluenzaA__ACV70517

SEQ ID NO: 17415 - protein, 469 aa, Artificial Sequence; identical to SEQ ID NO: 16738
  neuraminidase__InfluenzaA__ACV70527

SEQ ID NO: 17416 - protein, 469 aa, Artificial Sequence; identical to SEQ ID NO: 16738
  neuraminidase__InfluenzaA__ACV70547

SEQ ID NO: 17417 - protein, 469 aa, Artificial Sequence; identical to SEQ ID NO: 16738
  neuraminidase__InfluenzaA__ACV70557

SEQ ID NO: 17418 - protein, 469 aa, Artificial Sequence; identical to SEQ ID NO: 16738
  neuraminidase__InfluenzaA__ACV70567

SEQ ID NO: 17419 - protein, 469 aa, Artificial Sequence; identical to SEQ ID NO: 16738
  neuraminidase__InfluenzaA__ACV70577

SEQ ID NO: 17420 - protein, 469 aa, Artificial Sequence; identical to SEQ ID NO: 16738
  neuraminidase__InfluenzaA__ACV70587

SEQ ID NO: 17421 - protein, 469 aa, Artificial Sequence; identical to SEQ ID NO: 16728
  neuraminidase__InfluenzaA__ACV70597

SEQ ID NO: 17422 - protein, 469 aa, Artificial Sequence; identical to SEQ ID NO: 16738
  neuraminidase__InfluenzaA__ACV70607

SEQ ID NO: 17423 - protein, 469 aa, Artificial Sequence; identical to SEQ ID NO: 17321
  neuraminidase__InfluenzaA__ACV70617

SEQ ID NO: 17424 - protein, 469 aa, Artificial Sequence; identical to SEQ ID NO: 16738
  neuraminidase__InfluenzaA__ACV70647

SEQ ID NO: 17425 - protein, 469 aa, Artificial Sequence; identical to SEQ ID NO: 16738
  neuraminidase__InfluenzaA__ACV70657

SEQ ID NO: 17426 - protein, 469 aa, Artificial Sequence; identical to SEQ ID NO: 16738
  neuraminidase__InfluenzaA__ACV70667

SEQ ID NO: 17427 - protein, 469 aa, Artificial Sequence; identical to SEQ ID NO: 16738
  neuraminidase__InfluenzaA__ACV70677

SEQ ID NO: 17428 - protein, 469 aa, Artificial Sequence; identical to SEQ ID NO: 16738
  neuraminidase__InfluenzaA__ACV70687

SEQ ID NO: 17429 - protein, 469 aa, Artificial Sequence; identical to SEQ ID NO: 16738
  neuraminidase__InfluenzaA__ACV70697

SEQ ID NO: 17430 - protein, 469 aa, Artificial Sequence; identical to SEQ ID NO: 16738
  neuraminidase__InfluenzaA__ACV70707

SEQ ID NO: 17431 - protein, 469 aa, Artificial Sequence; identical to SEQ ID NO: 16738
  neuraminidase__InfluenzaA__ACV70717

SEQ ID NO: 17432 - protein, 469 aa, Artificial Sequence; identical to SEQ ID NO: 16738
  neuraminidase__InfluenzaA__ACV70727

SEQ ID NO: 17433 - protein, 469 aa, Artificial Sequence; identical to SEQ ID NO: 16738
  neuraminidase__InfluenzaA__ACV70737

SEQ ID NO: 17434 - protein, 469 aa, Artificial Sequence; identical to SEQ ID NO: 16738
  neuraminidase__InfluenzaA__ACV70757

SEQ ID NO: 17435 - protein, 469 aa, Artificial Sequence; identical to SEQ ID NO: 16738
  neuraminidase__InfluenzaA__ACV70767

SEQ ID NO: 17436 - protein, 469 aa, Artificial Sequence; identical to SEQ ID NO: 16738
  neuraminidase__InfluenzaA__ACV70777

SEQ ID NO: 17437 - protein, 469 aa, Artificial Sequence; identical to SEQ ID NO: 16738
  neuraminidase__InfluenzaA__ACV70787

SEQ ID NO: 17438 - protein, 469 aa, Artificial Sequence; identical to SEQ ID NO: 16738
  neuraminidase__InfluenzaA__ACV70797

SEQ ID NO: 17439 - protein, 469 aa, Artificial Sequence; identical to SEQ ID NO: 16738
  neuraminidase__InfluenzaA__ACV70807

SEQ ID NO: 17440 - protein, 469 aa, Artificial Sequence; identical to SEQ ID NO: 16738
  neuraminidase__InfluenzaA__ACV70817

SEQ ID NO: 17441 - protein, 469 aa, Artificial Sequence; identical to SEQ ID NO: 16728
  neuraminidase__InfluenzaA__ACV70827

SEQ ID NO: 17442 - protein, 469 aa, Artificial Sequence; identical to SEQ ID NO: 16738
  neuraminidase__InfluenzaA__ACV70837

SEQ ID NO: 17443 - protein, 469 aa, Artificial Sequence
  neuraminidase__InfluenzaA__ACV70847
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFMSCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17444 - protein, 469 aa, Artificial Sequence; identical to SEQ ID NO: 16738
  neuraminidase__InfluenzaA__ACV70867

SEQ ID NO: 17445 - protein, 469 aa, Artificial Sequence; identical to SEQ ID NO: 16738
  neuraminidase__InfluenzaA__ACV70877

SEQ ID NO: 17446 - protein, 469 aa, Artificial Sequence
  neuraminidase__InfluenzaA__ACV70887
MNPNQKIITIGSVCMTIGMANLILQIGNIISIWISHSIQLGNQNQIETCNQSVITYENNTWVNQTYVNISNTNFAAGQSMVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17447 - protein, 469 aa, Artificial Sequence; identical to SEQ ID NO: 16738
  neuraminidase__InfluenzaA__ACV70897

SEQ ID NO: 17448 - protein, 469 aa, Artificial Sequence; identical to SEQ ID NO: 16738
  neuraminidase__InfluenzaA__ACV70907

SEQ ID NO: 17449 - protein, 469 aa, Artificial Sequence; identical to SEQ ID NO: 16738
  neuraminidase__InfluenzaA__ACV70917

SEQ ID NO: 17450 - protein, 469 aa, Artificial Sequence; identical to SEQ ID NO: 16728
  neuraminidase__InfluenzaA__ACV70927

SEQ ID NO: 17451 - protein, 469 aa, Artificial Sequence; identical to SEQ ID NO: 16738
  neuraminidase__InfluenzaA__ACV70937

SEQ ID NO: 17452 - protein, 469 aa, Artificial Sequence; identical to SEQ ID NO: 16738
  neuraminidase__InfluenzaA__ACV70947

SEQ ID NO: 17453 - protein, 469 aa, Artificial Sequence; identical to SEQ ID NO: 16738
  neuraminidase__InfluenzaA__ACV70957

SEQ ID NO: 17454 - protein, 469 aa, Artificial Sequence; identical to SEQ ID NO: 16738
  neuraminidase__InfluenzaA__ACV70967

SEQ ID NO: 17455 - protein, 469 aa, Artificial Sequence; identical to SEQ ID NO: 16738
  neuraminidase__InfluenzaA__ACV70977

SEQ ID NO: 17456 - protein, 469 aa, Artificial Sequence; identical to SEQ ID NO: 16738
  neuraminidase__InfluenzaA__ACV70987

SEQ ID NO: 17457 - protein, 469 aa, Artificial Sequence; identical to SEQ ID NO: 16738
  neuraminidase__InfluenzaA__ACV71007

SEQ ID NO: 17458 - protein, 469 aa, Artificial Sequence; identical to SEQ ID NO: 16599
  neuraminidase__InfluenzaA__ACV82218

SEQ ID NO: 17459 - protein, 469 aa, Artificial Sequence; identical to SEQ ID NO: 16599
  neuraminidase__InfluenzaA__ACV82219

SEQ ID NO: 17460 - protein, 469 aa, Artificial Sequence
  neuraminidase__InfluenzaA__ACV82220
MNPNQKIITIGSVSLTISTICFFMQLAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSYSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEKTEVLWTSNSIVVFCGTSGTYGTGSWPDGADINLMPI

SEQ ID NO: 17461 - protein, 470 aa, Artificial Sequence
  neuraminidase__InfluenzaA__ACV82221
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17462 - protein, 469 aa, Artificial Sequence; identical to SEQ ID NO: 16738
  neuraminidase__InfluenzaA__ACV88402

SEQ ID NO: 17463 - protein, 469 aa, Artificial Sequence; identical to SEQ ID NO: 16738
  neuraminidase__InfluenzaA__ACV88412

SEQ ID NO: 17464 - protein, 469 aa, Artificial Sequence; identical to SEQ ID NO: 16728
  neuraminidase__InfluenzaA__ACV88422

SEQ ID NO: 17465 - protein, 454 aa, Artificial Sequence
  neuraminidase__InfluenzaA__ACV89505
MNPNQKIITIGSICLVVGLISLILQIGNIISIWISHSIQTGSQNHTGICNQNIITYKNSTWVKDTTSVILTGNSSLCPIRGWAIYSKDNSIRIGSKGDVFVIREPFISCSHLECRTFFLTQGALLNDKHSSGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSDGLASYKIFKIEKGKVTKSIELNAPNSHYEECSCYPDTGKVMCVCRDNWHGSNRPWVSFDQNLDYQIGYICSGVFGDNPRPEDGTGSCGPVYVDGANGVKGFSYRYGNGVWIGRTKSHSSRHGFEMIWDPNGWTETDSKFSVRQDVVAMTDWSGYSGSFVQHPELTGLDCMRPCFWVELIRGRPKEGTIWTSASSISFCGVNSDTVDWSWPDGAELPFSIDK

SEQ ID NO: 17466 - protein, 469 aa, Artificial Sequence; identical to SEQ ID NO: 16738
  neuraminidase__InfluenzaA__ACV91673

SEQ ID NO: 17467 - protein, 469 aa, Artificial Sequence; identical to SEQ ID NO: 16738
  neuraminidase__InfluenzaA__ACV91681

SEQ ID NO: 17468 - protein, 469 aa, Artificial Sequence
  neuraminidase__InfluenzaA__ACX31593
MNPNQKIITIGSVSLTISTICFFMQIAILITTVTLHFKQYEFNSPPNNQVLLCEPAIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 17469 - protein, 469 aa, Artificial Sequence; identical to SEQ ID NO: 16738
  neuraminidase__InfluenzaA__ACX31901

SEQ ID NO: 17470 - protein, 469 aa, Artificial Sequence; identical to SEQ ID NO: 16738
  neuraminidase__InfluenzaA__ACX31902

SEQ ID NO: 17471 - protein, 469 aa, Artificial Sequence; identical to SEQ ID NO: 16738
  neuraminidase__InfluenzaA__ACX31905

SEQ ID NO: 17472 - protein, 469 aa, Artificial Sequence; identical to SEQ ID NO: 16738
  neuraminidase__InfluenzaA__ACX31906

SEQ ID NO: 17473 - protein, 469 aa, Artificial Sequence; identical to SEQ ID NO: 16738
  neuraminidase__InfluenzaA__ACX31907

SEQ ID NO: 17474 - protein, 469 aa, Artificial Sequence; identical to SEQ ID NO: 16738
  neuraminidase__InfluenzaA__ACX31908

SEQ ID NO: 17475 - protein, 469 aa, Artificial Sequence; identical to SEQ ID NO: 16893
  neuraminidase__InfluenzaA__ACX31909

SEQ ID NO: 17476 - protein, 469 aa, Artificial Sequence; identical to SEQ ID NO: 16738
  neuraminidase__InfluenzaA__ACX31911

SEQ ID NO: 17477 - protein, 469 aa, Artificial Sequence; identical to SEQ ID NO: 16738
  neuraminidase__InfluenzaA__ACX31912

SEQ ID NO: 17478 - protein, 469 aa, Artificial Sequence; identical to SEQ ID NO: 16738
  neuraminidase__InfluenzaA__ACX31913

SEQ ID NO: 17479 - protein, 469 aa, Artificial Sequence; identical to SEQ ID NO: 16738
  neuraminidase__InfluenzaA__ACX31914

SEQ ID NO: 17480 - protein, 469 aa, Artificial Sequence; identical to SEQ ID NO: 16738
  neuraminidase__InfluenzaA__ACX31915

SEQ ID NO: 17481 - protein, 469 aa, Artificial Sequence; identical to SEQ ID NO: 16738
  neuraminidase__InfluenzaA__ACX31916

SEQ ID NO: 17482 - protein, 469 aa, Artificial Sequence
  neuraminidase__InfluenzaA__ACX31917
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTITDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17483 - protein, 469 aa, Artificial Sequence; identical to SEQ ID NO: 16738
  neuraminidase__InfluenzaA__ACX31918

SEQ ID NO: 17484 - protein, 469 aa, Artificial Sequence; identical to SEQ ID NO: 16738
  neuraminidase__InfluenzaA__ACX31919

SEQ ID NO: 17485 - protein, 469 aa, Artificial Sequence; identical to SEQ ID NO: 16738
  neuraminidase__InfluenzaA__ACX31920

SEQ ID NO: 17486 - protein, 469 aa, Artificial Sequence; identical to SEQ ID NO: 17092
  neuraminidase__InfluenzaA__ACX31922

SEQ ID NO: 17487 - protein, 469 aa, Artificial Sequence; identical to SEQ ID NO: 16738
  neuraminidase__InfluenzaA__ACX31923

SEQ ID NO: 17488 - protein, 469 aa, Artificial Sequence; identical to SEQ ID NO: 16728
  neuraminidase__InfluenzaA__ACX31924

SEQ ID NO: 17489 - protein, 469 aa, Artificial Sequence
  neuraminidase__InfluenzaA__ACX31925
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTLMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFIIDK

SEQ ID NO: 17490 - protein, 469 aa, Artificial Sequence; identical to SEQ ID NO: 16738
  neuraminidase__InfluenzaA__ACX31926

SEQ ID NO: 17491 - protein, 469 aa, Artificial Sequence; identical to SEQ ID NO: 16738
  neuraminidase__InfluenzaA__ACX31927

SEQ ID NO: 17492 - protein, 469 aa, Artificial Sequence
  neuraminidase__InfluenzaA__ACX31928
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGENGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNGDTVGWSWPDGAELPFTIDK

SEQ ID NO: 17493 - protein, 469 aa, Artificial Sequence; identical to SEQ ID NO: 16768
  neuraminidase__InfluenzaA__ACX31929

SEQ ID NO: 17494 - protein, 469 aa, Artificial Sequence; identical to SEQ ID NO: 17092
  neuraminidase__InfluenzaA__ACX31930

SEQ ID NO: 17495 - protein, 469 aa, Artificial Sequence; identical to SEQ ID NO: 16738
  neuraminidase__InfluenzaA__ACX31931

SEQ ID NO: 17496 - protein, 469 aa, Artificial Sequence; identical to SEQ ID NO: 16738
  neuraminidase__InfluenzaA__ACX31932

SEQ ID NO: 17497 - protein, 469 aa, Artificial Sequence; identical to SEQ ID NO: 16738
  neuraminidase__InfluenzaA__ACX35250

SEQ ID NO: 17498 - protein, 469 aa, Artificial Sequence; identical to SEQ ID NO: 16738
  neuraminidase__InfluenzaA__ACX35260

SEQ ID NO: 17499 - protein, 469 aa, Artificial Sequence; identical to SEQ ID NO: 16738
  neuraminidase__InfluenzaA__ACX35270

SEQ ID NO: 17500 - protein, 469 aa, Artificial Sequence
  neuraminidase__InfluenzaA__ACX35280
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVDMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17501 - protein, 469 aa, Artificial Sequence; identical to SEQ ID NO: 16738
  neuraminidase__InfluenzaA__ACX35290

SEQ ID NO: 17502 - protein, 469 aa, Artificial Sequence; identical to SEQ ID NO: 16738
  neuraminidase__InfluenzaA__ACX35300

SEQ ID NO: 17503 - protein, 469 aa, Artificial Sequence
  neuraminidase__InfluenzaA__ACX35310
MNPNQKIITIGSVCMTIGMANLILQIGNIISIWISHSIQLGNQNQIGTCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17504 - protein, 469 aa, Artificial Sequence; identical to SEQ ID NO: 16738
  neuraminidase__InfluenzaA__ACX35320

SEQ ID NO: 17505 - protein, 469 aa, Artificial Sequence
  neuraminidase__InfluenzaA__ACX35330
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17506 - protein, 469 aa, Artificial Sequence; identical to SEQ ID NO: 16738
  neuraminidase__InfluenzaA__ACX48479

SEQ ID NO: 17507 - protein, 469 aa, Artificial Sequence; identical to SEQ ID NO: 16738
  neuraminidase__InfluenzaA__ACX48481

SEQ ID NO: 17508 - protein, 469 aa, Artificial Sequence; identical to SEQ ID NO: 16738
  neuraminidase__InfluenzaA__ACX55836

SEQ ID NO: 17509 - protein, 469 aa, Artificial Sequence
  neuraminidase__InfluenzaA__ACX56269
MNPKQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17510 - protein, 469 aa, Artificial Sequence
  neuraminidase__InfluenzaA__ACX56270
MNPKQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDSVSWSWPDGAELPFTIDK

SEQ ID NO: 17511 - protein, 469 aa, Artificial Sequence
  neuraminidase__InfluenzaA__ACX56271
MNPKQKIITIGSVCMTIGMANLILQIGNIISIWISHSIQLGNQNQIETCNQSVITYENNTWVNQTYVNISNTNLAAGQSVGSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17512 - protein, 469 aa, Artificial Sequence; identical to SEQ ID NO: 16738
  neuraminidase__InfluenzaA__ACX83579

SEQ ID NO: 17513 - protein, 469 aa, Artificial Sequence; identical to SEQ ID NO: 16738
  neuraminidase__InfluenzaA__ACX85425

SEQ ID NO: 17514 - protein, 469 aa, Artificial Sequence; identical to SEQ ID NO: 16738
  neuraminidase__InfluenzaA__ACX85426

SEQ ID NO: 17515 - protein, 469 aa, Artificial Sequence
  neuraminidase__InfluenzaA__ACY02998
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSGEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17516 - protein, 469 aa, Artificial Sequence; identical to SEQ ID NO: 16738
  neuraminidase__InfluenzaA__ACY03005

SEQ ID NO: 17517 - protein, 469 aa, Artificial Sequence; identical to SEQ ID NO: 16738
  neuraminidase__InfluenzaA__ACY03008

SEQ ID NO: 17518 - protein, 469 aa, Artificial Sequence; identical to SEQ ID NO: 16738
  neuraminidase__InfluenzaA__ACY03011

SEQ ID NO: 17519 - protein, 469 aa, Artificial Sequence; identical to SEQ ID NO: 16738
  neuraminidase__InfluenzaA__ACY03012

SEQ ID NO: 17520 - protein, 469 aa, Artificial Sequence; identical to SEQ ID NO: 16738
  neuraminidase__InfluenzaA__ACY03016

SEQ ID NO: 17521 - protein, 469 aa, Artificial Sequence; identical to SEQ ID NO: 16738
  neuraminidase__InfluenzaA__ACY26194

SEQ ID NO: 17522 - protein, 469 aa, Artificial Sequence; identical to SEQ ID NO: 16738
  neuraminidase__InfluenzaA__ACY26204

SEQ ID NO: 17523 - protein, 469 aa, Artificial Sequence; identical to SEQ ID NO: 16738
  neuraminidase__InfluenzaA__ACY30123

SEQ ID NO: 17524 - protein, 469 aa, Artificial Sequence; identical to SEQ ID NO: 16738
  neuraminidase__InfluenzaA__ACY30124

SEQ ID NO: 17525 - protein, 469 aa, Artificial Sequence; identical to SEQ ID NO: 16738
  neuraminidase__InfluenzaA__ACY30125

SEQ ID NO: 17526 - protein, 469 aa, Artificial Sequence; identical to SEQ ID NO: 16738
  neuraminidase__InfluenzaA__ACY30127

SEQ ID NO: 17527 - protein, 469 aa, Artificial Sequence; identical to SEQ ID NO: 16738
  neuraminidase__InfluenzaA__ACY30128

SEQ ID NO: 17528 - protein, 469 aa, Artificial Sequence; identical to SEQ ID NO: 16738
  neuraminidase__InfluenzaA__ACY46105

SEQ ID NO: 17529 - protein, 469 aa, Artificial Sequence; identical to SEQ ID NO: 16738
  neuraminidase__InfluenzaA__ACY46165

SEQ ID NO: 17530 - protein, 469 aa, Artificial Sequence; identical to SEQ ID NO: 16738
  neuraminidase__InfluenzaA__ACY46175

SEQ ID NO: 17531 - protein, 469 aa, Artificial Sequence; identical to SEQ ID NO: 16738
  neuraminidase__InfluenzaA__ACY46345

SEQ ID NO: 17532 - protein, 469 aa, Artificial Sequence; identical to SEQ ID NO: 16738
  neuraminidase__InfluenzaA__ACY46385

SEQ ID NO: 17533 - protein, 469 aa, Artificial Sequence; identical to SEQ ID NO: 16738
  neuraminidase__InfluenzaA__ACY46485

SEQ ID NO: 17534 - protein, 469 aa, Artificial Sequence; identical to SEQ ID NO: 16768
  neuraminidase__InfluenzaA__ACY77536

SEQ ID NO: 17535 - protein, 469 aa, Artificial Sequence; identical to SEQ ID NO: 16728
  neuraminidase__InfluenzaA__ACY77546

SEQ ID NO: 17536 - protein, 469 aa, Artificial Sequence; identical to SEQ ID NO: 16768
  neuraminidase__InfluenzaA__ACY77565

SEQ ID NO: 17537 - protein, 469 aa, Artificial Sequence
  neuraminidase__InfluenzaA__ACY77575
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPSDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17538 - protein, 469 aa, Artificial Sequence; identical to SEQ ID NO: 16738
  neuraminidase__InfluenzaA__ACY77585

SEQ ID NO: 17539 - protein, 469 aa, Artificial Sequence; identical to SEQ ID NO: 16768
  neuraminidase__InfluenzaA__ACY77595

SEQ ID NO: 17540 - protein, 469 aa, Artificial Sequence; identical to SEQ ID NO: 16768
  neuraminidase__InfluenzaA__ACY77605

SEQ ID NO: 17541 - protein, 469 aa, Artificial Sequence; identical to SEQ ID NO: 16738
  neuraminidase__InfluenzaA__ACY77625

SEQ ID NO: 17542 - protein, 469 aa, Artificial Sequence
  neuraminidase__InfluenzaA__ACY77655
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSFNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17543 - protein, 469 aa, Artificial Sequence; identical to SEQ ID NO: 16738
  neuraminidase__InfluenzaA__ACY77665

SEQ ID NO: 17544 - protein, 469 aa, Artificial Sequence; identical to SEQ ID NO: 16738
  neuraminidase__InfluenzaA__ACY77675

SEQ ID NO: 17545 - protein, 469 aa, Artificial Sequence; identical to SEQ ID NO: 16728
  neuraminidase__InfluenzaA__ACY77685

SEQ ID NO: 17546 - protein, 469 aa, Artificial Sequence; identical to SEQ ID NO: 16728
  neuraminidase__InfluenzaA__ACY77695

SEQ ID NO: 17547 - protein, 469 aa, Artificial Sequence; identical to SEQ ID NO: 16728
  neuraminidase__InfluenzaA__ACY77705

SEQ ID NO: 17548 - protein, 469 aa, Artificial Sequence; identical to SEQ ID NO: 16728
  neuraminidase__InfluenzaA__ACY77725

SEQ ID NO: 17549 - protein, 469 aa, Artificial Sequence; identical to SEQ ID NO: 16728
  neuraminidase__InfluenzaA__ACY77735

SEQ ID NO: 17550 - protein, 469 aa, Artificial Sequence; identical to SEQ ID NO: 16738
  neuraminidase__InfluenzaA__ACY77745

SEQ ID NO: 17551 - protein, 469 aa, Artificial Sequence; identical to SEQ ID NO: 16738
  neuraminidase__InfluenzaA__ACY77755

SEQ ID NO: 17552 - protein, 469 aa, Artificial Sequence; identical to SEQ ID NO: 16738
  neuraminidase__InfluenzaA__ACY77775

SEQ ID NO: 17553 - protein, 469 aa, Artificial Sequence; identical to SEQ ID NO: 16738
  neuraminidase__InfluenzaA__ACY77785

SEQ ID NO: 17554 - protein, 469 aa, Artificial Sequence; identical to SEQ ID NO: 16738
  neuraminidase__InfluenzaA__ACY77795

SEQ ID NO: 17555 - protein, 469 aa, Artificial Sequence
  neuraminidase__InfluenzaA__ACY77825
MNPNQKIITIGSVCMTIGMANLILQIGNIISIWISHSIQLGNQNQIETCNQSVITYENNTWVNQTYVNISNTNFAAGQSVVSAKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSINSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17556 - protein, 469 aa, Artificial Sequence; identical to SEQ ID NO: 17555
  neuraminidase__InfluenzaA__ACY77835

SEQ ID NO: 17557 - protein, 469 aa, Artificial Sequence; identical to SEQ ID NO: 16768
  neuraminidase__InfluenzaA__ACY77845

SEQ ID NO: 17558 - protein, 469 aa, Artificial Sequence; identical to SEQ ID NO: 16738
  neuraminidase__InfluenzaA__ACY77865

SEQ ID NO: 17559 - protein, 469 aa, Artificial Sequence
  neuraminidase__InfluenzaA__ACY77870
MNPNQKIITIGSVCMTIGMANLILQIGNIISIWISHSIQLGNQNQIETCNQSVITYENNTWVNQTYVNISNTNLAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17560 - protein, 469 aa, Artificial Sequence; identical to SEQ ID NO: 16738
  neuraminidase__InfluenzaA__ACY77877

SEQ ID NO: 17561 - protein, 469 aa, Artificial Sequence; identical to SEQ ID NO: 16738
  neuraminidase__InfluenzaA__ACY77887

SEQ ID NO: 17562 - protein, 469 aa, Artificial Sequence; identical to SEQ ID NO: 16738
  neuraminidase__InfluenzaA__ACY77907

SEQ ID NO: 17563 - protein, 469 aa, Artificial Sequence; identical to SEQ ID NO: 16768
  neuraminidase__InfluenzaA__ACY77917

SEQ ID NO: 17564 - protein, 469 aa, Artificial Sequence
  neuraminidase__InfluenzaA__ACY77927
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPNNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17565 - protein, 469 aa, Artificial Sequence; identical to SEQ ID NO: 16738
  neuraminidase__InfluenzaA__ACY77937

SEQ ID NO: 17566 - protein, 469 aa, Artificial Sequence; identical to SEQ ID NO: 16738
  neuraminidase__InfluenzaA__ACY77947

SEQ ID NO: 17567 - protein, 469 aa, Artificial Sequence; identical to SEQ ID NO: 16738
  neuraminidase__InfluenzaA__ACY77967

SEQ ID NO: 17568 - protein, 469 aa, Artificial Sequence; identical to SEQ ID NO: 16728
  neuraminidase__InfluenzaA__ACY77977

SEQ ID NO: 17569 - protein, 469 aa, Artificial Sequence; identical to SEQ ID NO: 16738
  neuraminidase__InfluenzaA__ACY77987

SEQ ID NO: 17570 - protein, 469 aa, Artificial Sequence
  neuraminidase__InfluenzaA__ACY77997
MNPNQKIITIGSVCMTIGMANLILQIGNIISIWISHSIQLGNQNQIETCNQSVITYENNTWVNQTYVNISNTNFAAGQSVVSVTLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17571 - protein, 469 aa, Artificial Sequence; identical to SEQ ID NO: 16738
  neuraminidase__InfluenzaA__ACY78017

SEQ ID NO: 17572 - protein, 469 aa, Artificial Sequence
  neuraminidase__InfluenzaA__ACZ01955
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPGNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17573 - protein, 469 aa, Artificial Sequence; identical to SEQ ID NO: 16738
  neuraminidase__InfluenzaA__ACZ05053

SEQ ID NO: 17574 - protein, 469 aa, Artificial Sequence; identical to SEQ ID NO: 16728
  neuraminidase__InfluenzaA__ACZ05064

SEQ ID NO: 17575 - protein, 469 aa, Artificial Sequence; identical to SEQ ID NO: 16738
  neuraminidase__InfluenzaA__ACZ05074

SEQ ID NO: 17576 - protein, 469 aa, Artificial Sequence; identical to SEQ ID NO: 16738
  neuraminidase__InfluenzaA__ACZ05084

SEQ ID NO: 17577 - protein, 469 aa, Artificial Sequence; identical to SEQ ID NO: 16738
  neuraminidase__InfluenzaA__ACZ05094

SEQ ID NO: 17578 - protein, 469 aa, Artificial Sequence; identical to SEQ ID NO: 16738
  neuraminidase__InfluenzaA__ACZ05104

SEQ ID NO: 17579 - protein, 469 aa, Artificial Sequence; identical to SEQ ID NO: 16738
  neuraminidase__InfluenzaA__ACZ05114

SEQ ID NO: 17580 - protein, 469 aa, Artificial Sequence; identical to SEQ ID NO: 16738
  neuraminidase__InfluenzaA__ACZ05124

SEQ ID NO: 17581 - protein, 469 aa, Artificial Sequence; identical to SEQ ID NO: 16738
  neuraminidase__InfluenzaA__ACZ05144

SEQ ID NO: 17582 - protein, 469 aa, Artificial Sequence; identical to SEQ ID NO: 16738
  neuraminidase__InfluenzaA__ACZ05154

SEQ ID NO: 17583 - protein, 469 aa, Artificial Sequence; identical to SEQ ID NO: 16599
  neuraminidase__InfluenzaA__ACZ05164

SEQ ID NO: 17584 - protein, 469 aa, Artificial Sequence; identical to SEQ ID NO: 16599
  neuraminidase__InfluenzaA__ACZ05175

SEQ ID NO: 17585 - protein, 470 aa, Artificial Sequence
  neuraminidase__InfluenzaA__ACZ05197
MNPNQKIMTIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17586 - protein, 469 aa, Artificial Sequence
  neuraminidase__InfluenzaA__ACZ05208
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCSDPNNEEGGHGVKGWAFDSGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 17587 - protein, 469 aa, Artificial Sequence
  neuraminidase__InfluenzaA__ACZ05219
MNPNQKIITIGSVSLTISTICFFMQIAILITTVTLHFKQYEFNSPPNNQVMLCEPTIIERNITEIVYLTNTTIEKEICPKLAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 17588 - protein, 469 aa, Artificial Sequence; identical to SEQ ID NO: 16599
  neuraminidase__InfluenzaA__ACZ05230

SEQ ID NO: 17589 - protein, 469 aa, Artificial Sequence
  neuraminidase__InfluenzaA__ACZ05241
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSKLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 17590 - protein, 470 aa, Artificial Sequence
  neuraminidase__InfluenzaA__ACZ05296
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVAVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17591 - protein, 469 aa, Artificial Sequence; identical to SEQ ID NO: 16599
  neuraminidase__InfluenzaA__ACZ05307

SEQ ID NO: 17592 - protein, 469 aa, Artificial Sequence
  neuraminidase__InfluenzaA__ACZ05318
MNPNQKIITIGSVSLTISTICFFMQTAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 17593 - protein, 469 aa, Artificial Sequence; identical to SEQ ID NO: 16599
  neuraminidase__InfluenzaA__ACZ05329

SEQ ID NO: 17594 - protein, 469 aa, Artificial Sequence; identical to SEQ ID NO: 16512
  neuraminidase__InfluenzaA__ACZ05340

SEQ ID NO: 17595 - protein, 469 aa, Artificial Sequence; identical to SEQ ID NO: 17589
  neuraminidase__InfluenzaA__ACZ05362

SEQ ID NO: 17596 - protein, 469 aa, Artificial Sequence; identical to SEQ ID NO: 16599
  neuraminidase__InfluenzaA__ACZ05373

SEQ ID NO: 17597 - protein, 469 aa, Artificial Sequence; identical to SEQ ID NO: 16599
  neuraminidase__InfluenzaA__ACZ05395

SEQ ID NO: 17598 - protein, 469 aa, Artificial Sequence; identical to SEQ ID NO: 16599
  neuraminidase__InfluenzaA__ACZ05406

SEQ ID NO: 17599 - protein, 470 aa, Artificial Sequence
  neuraminidase__InfluenzaA__ACZ05450
MNPNQKIITIGSISIAIGIISLMLQIGSIISIWASHSIQTGSQNNTGICNQRIITYENSTWVNHTYVNINNTNVVAGEDKTSVTLAGNSSLCSISGWAIYTKDNSVRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17600 - protein, 469 aa, Artificial Sequence; identical to SEQ ID NO: 16599
  neuraminidase__InfluenzaA__ACZ05461

SEQ ID NO: 17601 - protein, 469 aa, Artificial Sequence; identical to SEQ ID NO: 16599
  neuraminidase__InfluenzaA__ACZ05472

SEQ ID NO: 17602 - protein, 469 aa, Artificial Sequence
  neuraminidase__InfluenzaA__ACZ05483
MNPNQKIITIGSVSLTISTICFFMQIAILITTVTLHFKQYEFNSPPNNQVMLCEPTIIERNITEIVYLTNTTVEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 17603 - protein, 469 aa, Artificial Sequence; identical to SEQ ID NO: 16599
  neuraminidase__InfluenzaA__ACZ05494

SEQ ID NO: 17604 - protein, 469 aa, Artificial Sequence; identical to SEQ ID NO: 17592
  neuraminidase__InfluenzaA__ACZ05516

SEQ ID NO: 17605 - protein, 469 aa, Artificial Sequence
  neuraminidase__InfluenzaA__ACZ05527
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCSDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 17606 - protein, 469 aa, Artificial Sequence; identical to SEQ ID NO: 17589
  neuraminidase__InfluenzaA__ACZ05538

SEQ ID NO: 17607 - protein, 470 aa, Artificial Sequence; identical to SEQ ID NO: 17461
  neuraminidase__InfluenzaA__ACZ05593

SEQ ID NO: 17608 - protein, 470 aa, Artificial Sequence
  neuraminidase__InfluenzaA__ACZ05604
MNPNQKIITIGSISIAIGIISLMLQIGNIISIWASHSIQTGSQNNTGICNQRIITYENSTWVNHTYVNINNTNVVAGEDKTSVTLAGNSSLCSIRGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17609 - protein, 469 aa, Artificial Sequence; identical to SEQ ID NO: 16599
  neuraminidase__InfluenzaA__ACZ05953

SEQ ID NO: 17610 - protein, 469 aa, Artificial Sequence; identical to SEQ ID NO: 17605
  neuraminidase__InfluenzaA__ACZ05964

SEQ ID NO: 17611 - protein, 469 aa, Artificial Sequence; identical to SEQ ID NO: 16599
  neuraminidase__InfluenzaA__ACZ05997

SEQ ID NO: 17612 - protein, 469 aa, Artificial Sequence; identical to SEQ ID NO: 17605
  neuraminidase__InfluenzaA__ACZ06008

SEQ ID NO: 17613 - protein, 469 aa, Artificial Sequence; identical to SEQ ID NO: 17605
  neuraminidase__InfluenzaA__ACZ06019

SEQ ID NO: 17614 - protein, 470 aa, Artificial Sequence
  neuraminidase__InfluenzaA__ACZ16015
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVSKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17615 - protein, 470 aa, Artificial Sequence
  neuraminidase__InfluenzaA__ACZ16025
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTIKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17616 - protein, 470 aa, Artificial Sequence; identical to SEQ ID NO: 17461
  neuraminidase__InfluenzaA__ACZ16035

SEQ ID NO: 17617 - protein, 469 aa, Artificial Sequence
  neuraminidase__InfluenzaA__ACZ16043
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNNIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17618 - protein, 469 aa, Artificial Sequence
  neuraminidase__InfluenzaA__ACZ16053
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSTKQDIVGINEWSGYSGSFVQHPELTGLDCIRPCFWVELIRGRPKENTIWTSGSSISFCGVNSDTVGWSWPDGAELPFTIDK

SEQ ID NO: 17619 - protein, 469 aa, Artificial Sequence; identical to SEQ ID NO: 16728
  neuraminidase__InfluenzaA__ACZ16073

SEQ ID NO: 17620 - protein, 469 aa, Artificial Sequence
  neuraminidase__InfluenzaA__ACZ16083
MNPNQKIITIGSVCMTIGMANLILQIGNIISIWISHSIQLGNQNQIETCNQSVITYENNTWVNQTYVNISNTNFAARQSVVSVKLAGNSSLCPVSGWAIYSKDNSVRIGSKGDVFVIREPFISCSPLGCRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWIELIRGRPKENTIWTSGSSISFCGVNSDTVGWSWPDGAELPFTIDK

SEQ ID NO: 17621 - protein, 469 aa, Artificial Sequence; identical to SEQ ID NO: 16728
  neuraminidase__InfluenzaA__ACZ16093

SEQ ID NO: 17622 - protein, 469 aa, Artificial Sequence; identical to SEQ ID NO: 16738
  neuraminidase__InfluenzaA__ACZ16103

SEQ ID NO: 17623 - protein, 469 aa, Artificial Sequence; identical to SEQ ID NO: 16738
  neuraminidase__InfluenzaA__ACZ16113

SEQ ID NO: 17624 - protein, 469 aa, Artificial Sequence; identical to SEQ ID NO: 16738
  neuraminidase__InfluenzaA__ACZ16123

SEQ ID NO: 17625 - protein, 469 aa, Artificial Sequence
  neuraminidase__InfluenzaA__ACZ16133
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17626 - protein, 469 aa, Artificial Sequence
  neuraminidase__InfluenzaA__ACZ16143
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPLSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17627 - protein, 469 aa, Artificial Sequence; identical to SEQ ID NO: 16738
  neuraminidase__InfluenzaA__ACZ16153

SEQ ID NO: 17628 - protein, 469 aa, Artificial Sequence; identical to SEQ ID NO: 16738
  neuraminidase__InfluenzaA__ACZ16163

SEQ ID NO: 17629 - protein, 469 aa, Artificial Sequence; identical to SEQ ID NO: 16728
  neuraminidase__InfluenzaA__ACZ16173

SEQ ID NO: 17630 - protein, 469 aa, Artificial Sequence; identical to SEQ ID NO: 16738
  neuraminidase__InfluenzaA__ACZ16193

SEQ ID NO: 17631 - protein, 469 aa, Artificial Sequence; identical to SEQ ID NO: 16738
  neuraminidase__InfluenzaA__ACZ16203

SEQ ID NO: 17632 - protein, 469 aa, Artificial Sequence; identical to SEQ ID NO: 16738
  neuraminidase__InfluenzaA__ACZ16213

SEQ ID NO: 17633 - protein, 469 aa, Artificial Sequence
  neuraminidase__InfluenzaA__ACZ16223
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNETIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 17634 - protein, 469 aa, Artificial Sequence; identical to SEQ ID NO: 16738
  neuraminidase__InfluenzaA__ACZ16233

SEQ ID NO: 17635 - protein, 469 aa, Artificial Sequence; identical to SEQ ID NO: 17446
  neuraminidase__InfluenzaA__ACZ16243

SEQ ID NO: 17636 - protein, 469 aa, Artificial Sequence
  neuraminidase__InfluenzaA__ACZ16253
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFNIDK

SEQ ID NO: 17637 - protein, 469 aa, Artificial Sequence; identical to SEQ ID NO: 16738
  neuraminidase__InfluenzaA__ACZ16263

SEQ ID NO: 17638 - protein, 469 aa, Artificial Sequence; identical to SEQ ID NO: 16728
  neuraminidase__InfluenzaA__ACZ16283

SEQ ID NO: 17639 - protein, 469 aa, Artificial Sequence; identical to SEQ ID NO: 16738
  neuraminidase__InfluenzaA__ACZ16293

SEQ ID NO: 17640 - protein, 469 aa, Artificial Sequence; identical to SEQ ID NO: 16738
  neuraminidase__InfluenzaA__ACZ16303

SEQ ID NO: 17641 - protein, 469 aa, Artificial Sequence; identical to SEQ ID NO: 16738
  neuraminidase__InfluenzaA__ACZ16313

SEQ ID NO: 17642 - protein, 469 aa, Artificial Sequence; identical to SEQ ID NO: 16738
  neuraminidase__InfluenzaA__ACZ16323

SEQ ID NO: 17643 - protein, 469 aa, Artificial Sequence; identical to SEQ ID NO: 16738
  neuraminidase__InfluenzaA__ACZ16333

SEQ ID NO: 17644 - protein, 469 aa, Artificial Sequence; identical to SEQ ID NO: 17446
  neuraminidase__InfluenzaA__ACZ16343

SEQ ID NO: 17645 - protein, 469 aa, Artificial Sequence; identical to SEQ ID NO: 16738
  neuraminidase__InfluenzaA__ACZ16353

SEQ ID NO: 17646 - protein, 469 aa, Artificial Sequence; identical to SEQ ID NO: 16738
  neuraminidase__InfluenzaA__ACZ16363

SEQ ID NO: 17647 - protein, 469 aa, Artificial Sequence; identical to SEQ ID NO: 16728
  neuraminidase__InfluenzaA__ACZ16373

SEQ ID NO: 17648 - protein, 469 aa, Artificial Sequence; identical to SEQ ID NO: 16738
  neuraminidase__InfluenzaA__ACZ16383

SEQ ID NO: 17649 - protein, 469 aa, Artificial Sequence; identical to SEQ ID NO: 16738
  neuraminidase__InfluenzaA__ACZ16393

SEQ ID NO: 17650 - protein, 469 aa, Artificial Sequence; identical to SEQ ID NO: 16738
  neuraminidase__InfluenzaA__ACZ16403

SEQ ID NO: 17651 - protein, 469 aa, Artificial Sequence; identical to SEQ ID NO: 16738
  neuraminidase__InfluenzaA__ACZ16423

SEQ ID NO: 17652 - protein, 469 aa, Artificial Sequence; identical to SEQ ID NO: 16738
  neuraminidase__InfluenzaA__ACZ16433

SEQ ID NO: 17653 - protein, 469 aa, Artificial Sequence; identical to SEQ ID NO: 16738
  neuraminidase__InfluenzaA__ACZ16443

SEQ ID NO: 17654 - protein, 469 aa, Artificial Sequence; identical to SEQ ID NO: 16738
  neuraminidase__InfluenzaA__ACZ16453

SEQ ID NO: 17655 - protein, 469 aa, Artificial Sequence; identical to SEQ ID NO: 17446
  neuraminidase__InfluenzaA__ACZ16463

SEQ ID NO: 17656 - protein, 469 aa, Artificial Sequence; identical to SEQ ID NO: 16738
  neuraminidase__InfluenzaA__ACZ16483

SEQ ID NO: 17657 - protein, 469 aa, Artificial Sequence; identical to SEQ ID NO: 16738
  neuraminidase__InfluenzaA__ACZ16493

SEQ ID NO: 17658 - protein, 469 aa, Artificial Sequence
  neuraminidase__InfluenzaA__ACZ16503
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMDAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17659 - protein, 469 aa, Artificial Sequence; identical to SEQ ID NO: 17446
  neuraminidase__InfluenzaA__ACZ16513

SEQ ID NO: 17660 - protein, 469 aa, Artificial Sequence; identical to SEQ ID NO: 16738
  neuraminidase__InfluenzaA__ACZ16523

SEQ ID NO: 17661 - protein, 469 aa, Artificial Sequence; identical to SEQ ID NO: 16738
  neuraminidase__InfluenzaA__ACZ16533

SEQ ID NO: 17662 - protein, 469 aa, Artificial Sequence; identical to SEQ ID NO: 16728
  neuraminidase__InfluenzaA__ACZ16543

SEQ ID NO: 17663 - protein, 469 aa, Artificial Sequence; identical to SEQ ID NO: 16738
  neuraminidase__InfluenzaA__ACZ16553

SEQ ID NO: 17664 - protein, 469 aa, Artificial Sequence; identical to SEQ ID NO: 16738
  neuraminidase__InfluenzaA__ACZ16586

SEQ ID NO: 17665 - protein, 469 aa, Artificial Sequence; identical to SEQ ID NO: 16738
  neuraminidase__InfluenzaA__ACZ16596

SEQ ID NO: 17666 - protein, 469 aa, Artificial Sequence; identical to SEQ ID NO: 16738
  neuraminidase__InfluenzaA__ACZ16606

SEQ ID NO: 17667 - protein, 469 aa, Artificial Sequence; identical to SEQ ID NO: 16738
  neuraminidase__InfluenzaA__ACZ16633

SEQ ID NO: 17668 - protein, 469 aa, Artificial Sequence
  neuraminidase__InfluenzaA__ACZ16643
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLRYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17669 - protein, 469 aa, Artificial Sequence; identical to SEQ ID NO: 16738
  neuraminidase__InfluenzaA__ACZ16653

SEQ ID NO: 17670 - protein, 469 aa, Artificial Sequence; identical to SEQ ID NO: 16738
  neuraminidase__InfluenzaA__ACZ16663

SEQ ID NO: 17671 - protein, 469 aa, Artificial Sequence; identical to SEQ ID NO: 16738
  neuraminidase__InfluenzaA__ACZ16673

SEQ ID NO: 17672 - protein, 469 aa, Artificial Sequence; identical to SEQ ID NO: 16738
  neuraminidase__InfluenzaA__ACZ16683

SEQ ID NO: 17673 - protein, 469 aa, Artificial Sequence; identical to SEQ ID NO: 16738
  neuraminidase__InfluenzaA__ACZ16693

SEQ ID NO: 17674 - protein, 469 aa, Artificial Sequence; identical to SEQ ID NO: 16738
  neuraminidase__InfluenzaA__ACZ16703

SEQ ID NO: 17675 - protein, 469 aa, Artificial Sequence; identical to SEQ ID NO: 16738
  neuraminidase__InfluenzaA__ACZ16713

SEQ ID NO: 17676 - protein, 469 aa, Artificial Sequence; identical to SEQ ID NO: 16738
  neuraminidase__InfluenzaA__ACZ16723

SEQ ID NO: 17677 - protein, 469 aa, Artificial Sequence; identical to SEQ ID NO: 16738
  neuraminidase__InfluenzaA__ACZ16733

SEQ ID NO: 17678 - protein, 469 aa, Artificial Sequence; identical to SEQ ID NO: 16738
  neuraminidase__InfluenzaA__ACZ16743

SEQ ID NO: 17679 - protein, 469 aa, Artificial Sequence; identical to SEQ ID NO: 16738
  neuraminidase__InfluenzaA__ACZ16753

SEQ ID NO: 17680 - protein, 469 aa, Artificial Sequence; identical to SEQ ID NO: 16738
  neuraminidase__InfluenzaA__ACZ16763

SEQ ID NO: 17681 - protein, 469 aa, Artificial Sequence; identical to SEQ ID NO: 16728
  neuraminidase__InfluenzaA__ACZ16773

SEQ ID NO: 17682 - protein, 469 aa, Artificial Sequence; identical to SEQ ID NO: 16738
  neuraminidase__InfluenzaA__ACZ16783

SEQ ID NO: 17683 - protein, 469 aa, Artificial Sequence; identical to SEQ ID NO: 16738
  neuraminidase__InfluenzaA__ACZ16793

SEQ ID NO: 17684 - protein, 469 aa, Artificial Sequence; identical to SEQ ID NO: 16738
  neuraminidase__InfluenzaA__ACZ16803

SEQ ID NO: 17685 - protein, 469 aa, Artificial Sequence; identical to SEQ ID NO: 16738
  neuraminidase__InfluenzaA__ACZ16813

SEQ ID NO: 17686 - protein, 469 aa, Artificial Sequence; identical to SEQ ID NO: 16728
  neuraminidase__InfluenzaA__ACZ16823

SEQ ID NO: 17687 - protein, 469 aa, Artificial Sequence; identical to SEQ ID NO: 16738
  neuraminidase__InfluenzaA__ACZ16833

SEQ ID NO: 17688 - protein, 469 aa, Artificial Sequence; identical to SEQ ID NO: 16738
  neuraminidase__InfluenzaA__ACZ16843

SEQ ID NO: 17689 - protein, 469 aa, Artificial Sequence; identical to SEQ ID NO: 17658
  neuraminidase__InfluenzaA__ACZ16853

SEQ ID NO: 17690 - protein, 469 aa, Artificial Sequence; identical to SEQ ID NO: 16738
  neuraminidase__InfluenzaA__ACZ16863

SEQ ID NO: 17691 - protein, 469 aa, Artificial Sequence; identical to SEQ ID NO: 16738
  neuraminidase__InfluenzaA__ACZ16873

SEQ ID NO: 17692 - protein, 469 aa, Artificial Sequence; identical to SEQ ID NO: 16738
  neuraminidase__InfluenzaA__ACZ16883

SEQ ID NO: 17693 - protein, 469 aa, Artificial Sequence; identical to SEQ ID NO: 16738
  neuraminidase__InfluenzaA__ACZ16893

SEQ ID NO: 17694 - protein, 469 aa, Artificial Sequence; identical to SEQ ID NO: 16738
  neuraminidase__InfluenzaA__ACZ16903

SEQ ID NO: 17695 - protein, 469 aa, Artificial Sequence; identical to SEQ ID NO: 16738
  neuraminidase__InfluenzaA__ACZ16913

SEQ ID NO: 17696 - protein, 469 aa, Artificial Sequence; identical to SEQ ID NO: 16738
  neuraminidase__InfluenzaA__ACZ16923

SEQ ID NO: 17697 - protein, 469 aa, Artificial Sequence; identical to SEQ ID NO: 16738
  neuraminidase__InfluenzaA__ACZ16933

SEQ ID NO: 17698 - protein, 469 aa, Artificial Sequence; identical to SEQ ID NO: 16738
  neuraminidase__InfluenzaA__ACZ16943

SEQ ID NO: 17699 - protein, 469 aa, Artificial Sequence; identical to SEQ ID NO: 16728
  neuraminidase__InfluenzaA__ACZ16953

SEQ ID NO: 17700 - protein, 469 aa, Artificial Sequence; identical to SEQ ID NO: 16738
  neuraminidase__InfluenzaA__ACZ16963

SEQ ID NO: 17701 - protein, 469 aa, Artificial Sequence; identical to SEQ ID NO: 16738
  neuraminidase__InfluenzaA__ACZ16973

SEQ ID NO: 17702 - protein, 469 aa, Artificial Sequence; identical to SEQ ID NO: 16738
  neuraminidase__InfluenzaA__ACZ16983

SEQ ID NO: 17703 - protein, 469 aa, Artificial Sequence; identical to SEQ ID NO: 16738
  neuraminidase__InfluenzaA__ACZ16993

SEQ ID NO: 17704 - protein, 469 aa, Artificial Sequence; identical to SEQ ID NO: 16738
  neuraminidase__InfluenzaA__ACZ17003

SEQ ID NO: 17705 - protein, 469 aa, Artificial Sequence; identical to SEQ ID NO: 16738
  neuraminidase__InfluenzaA__ACZ17023

SEQ ID NO: 17706 - protein, 469 aa, Artificial Sequence; identical to SEQ ID NO: 16738
  neuraminidase__InfluenzaA__ACZ17043

SEQ ID NO: 17707 - protein, 469 aa, Artificial Sequence; identical to SEQ ID NO: 16738
  neuraminidase__InfluenzaA__ACZ17053

SEQ ID NO: 17708 - protein, 469 aa, Artificial Sequence
  neuraminidase__InfluenzaA__ACZ17063
MNPNQKIITIGSVCMTIGMANLILQIGNIISIWISHSIQLGDQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17709 - protein, 469 aa, Artificial Sequence; identical to SEQ ID NO: 16738
  neuraminidase__InfluenzaA__ACZ17073

SEQ ID NO: 17710 - protein, 469 aa, Artificial Sequence; identical to SEQ ID NO: 17446
  neuraminidase__InfluenzaA__ACZ17083

SEQ ID NO: 17711 - protein, 469 aa, Artificial Sequence
  neuraminidase__InfluenzaA__ACZ17093
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPFECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17712 - protein, 469 aa, Artificial Sequence
  neuraminidase__InfluenzaA__ACZ17113
MNPNQKIITIGSVCMTIGMANLILQIGNIISIWISHSIQLGNQNQIETCNQSVITYENNTWVNQTYVNISNTNFAAGQSVVSVKLAGNSSLCPVNGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17713 - protein, 469 aa, Artificial Sequence; identical to SEQ ID NO: 16738
  neuraminidase__InfluenzaA__ACZ17123

SEQ ID NO: 17714 - protein, 469 aa, Artificial Sequence; identical to SEQ ID NO: 16738
  neuraminidase__InfluenzaA__ACZ17133

SEQ ID NO: 17715 - protein, 469 aa, Artificial Sequence
  neuraminidase__InfluenzaA__ACZ17163
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNRNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17716 - protein, 469 aa, Artificial Sequence; identical to SEQ ID NO: 17715
  neuraminidase__InfluenzaA__ACZ17173

SEQ ID NO: 17717 - protein, 469 aa, Artificial Sequence; identical to SEQ ID NO: 17715
  neuraminidase__InfluenzaA__ACZ17183

SEQ ID NO: 17718 - protein, 469 aa, Artificial Sequence; identical to SEQ ID NO: 17715
  neuraminidase__InfluenzaA__ACZ17193

SEQ ID NO: 17719 - protein, 469 aa, Artificial Sequence; identical to SEQ ID NO: 17715
  neuraminidase__InfluenzaA__ACZ17203

SEQ ID NO: 17720 - protein, 469 aa, Artificial Sequence; identical to SEQ ID NO: 16738
  neuraminidase__InfluenzaA__ACZ17213

SEQ ID NO: 17721 - protein, 469 aa, Artificial Sequence; identical to SEQ ID NO: 16738
  neuraminidase__InfluenzaA__ACZ17223

SEQ ID NO: 17722 - protein, 469 aa, Artificial Sequence; identical to SEQ ID NO: 16738
  neuraminidase__InfluenzaA__ACZ17233

SEQ ID NO: 17723 - protein, 469 aa, Artificial Sequence; identical to SEQ ID NO: 16738
  neuraminidase__InfluenzaA__ACZ17243

SEQ ID NO: 17724 - protein, 469 aa, Artificial Sequence; identical to SEQ ID NO: 16738
  neuraminidase__InfluenzaA__ACZ17263

SEQ ID NO: 17725 - protein, 469 aa, Artificial Sequence
  neuraminidase__InfluenzaA__ACZ17273
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGFNWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVLSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17726 - protein, 469 aa, Artificial Sequence; identical to SEQ ID NO: 16738
  neuraminidase__InfluenzaA__ACZ17283

SEQ ID NO: 17727 - protein, 469 aa, Artificial Sequence; identical to SEQ ID NO: 16768
  neuraminidase__InfluenzaA__ACZ17293

SEQ ID NO: 17728 - protein, 469 aa, Artificial Sequence; identical to SEQ ID NO: 16768
  neuraminidase__InfluenzaA__ACZ17303

SEQ ID NO: 17729 - protein, 469 aa, Artificial Sequence; identical to SEQ ID NO: 16768
  neuraminidase__InfluenzaA__ACZ17313

SEQ ID NO: 17730 - protein, 469 aa, Artificial Sequence; identical to SEQ ID NO: 16738
  neuraminidase__InfluenzaA__ACZ17401

SEQ ID NO: 17731 - protein, 469 aa, Artificial Sequence; identical to SEQ ID NO: 16738
  neuraminidase__InfluenzaA__ACZ17411

SEQ ID NO: 17732 - protein, 469 aa, Artificial Sequence; identical to SEQ ID NO: 16738
  neuraminidase__InfluenzaA__ACZ17421

SEQ ID NO: 17733 - protein, 469 aa, Artificial Sequence
  neuraminidase__InfluenzaA__ACZ17431
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSINSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17734 - protein, 469 aa, Artificial Sequence; identical to SEQ ID NO: 17733
  neuraminidase__InfluenzaA__ACZ17441

SEQ ID NO: 17735 - protein, 469 aa, Artificial Sequence; identical to SEQ ID NO: 16728
  neuraminidase__InfluenzaA__ACZ17451

SEQ ID NO: 17736 - protein, 469 aa, Artificial Sequence; identical to SEQ ID NO: 16738
  neuraminidase__InfluenzaA__ACZ17461

SEQ ID NO: 17737 - protein, 469 aa, Artificial Sequence; identical to SEQ ID NO: 16738
  neuraminidase__InfluenzaA__ACZ17471

SEQ ID NO: 17738 - protein, 469 aa, Artificial Sequence; identical to SEQ ID NO: 16768
  neuraminidase__InfluenzaA__ACZ17481

SEQ ID NO: 17739 - protein, 469 aa, Artificial Sequence; identical to SEQ ID NO: 16738
  neuraminidase__InfluenzaA__ACZ17491

SEQ ID NO: 17740 - protein, 469 aa, Artificial Sequence; identical to SEQ ID NO: 17204
  neuraminidase__InfluenzaA__ACZ27803

SEQ ID NO: 17741 - protein, 469 aa, Artificial Sequence; identical to SEQ ID NO: 16728
  neuraminidase__InfluenzaA__ACZ27813

SEQ ID NO: 17742 - protein, 469 aa, Artificial Sequence; identical to SEQ ID NO: 16738
  neuraminidase__InfluenzaA__ACZ27823

SEQ ID NO: 17743 - protein, 469 aa, Artificial Sequence; identical to SEQ ID NO: 16728
  neuraminidase__InfluenzaA__ACZ27833

SEQ ID NO: 17744 - protein, 469 aa, Artificial Sequence; identical to SEQ ID NO: 16738
  neuraminidase__InfluenzaA__ACZ45022

SEQ ID NO: 17745 - protein, 469 aa, Artificial Sequence
  neuraminidase__InfluenzaA__ACZ53958
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSCPDGSVLNLMPI

SEQ ID NO: 17746 - protein, 469 aa, Artificial Sequence
  neuraminidase__InfluenzaA__ACZ53969
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGEIVHTSPLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIVDRGNRSGYSGIFSVEGKSCINRCFYVELIRGRKQETEVLWTSNSIVVFCGTSGTYGTGSWPDGSVLNLMPI

SEQ ID NO: 17747 - protein, 469 aa, Artificial Sequence
  neuraminidase__InfluenzaA__ACZ53980
MNPNQNKLPIGSVSLTIATICFLMQIAILKTTVTLHFKQYECNSPPNNQVMLCEPTIIERNLTKIVYLTNTTIKKEICPKQPKYRNWSKPKCKITELAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHISPLSGSAQHVEECSCYPRYPGVRCICRDNWKGSNRPVVDINMEDYSIDSSYVCSGLVGDTPRKNDSSSSSHCLDPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVLWTSNSIVVFCGTSGTYGTGSWPDGSVLNLMPI

SEQ ID NO: 17748 - protein, 469 aa, Artificial Sequence; identical to SEQ ID NO: 16738
  neuraminidase__InfluenzaA__ACZ56082

SEQ ID NO: 17749 - protein, 469 aa, Artificial Sequence; identical to SEQ ID NO: 17321
  neuraminidase__InfluenzaA__ACZ57183

SEQ ID NO: 17750 - protein, 470 aa, Artificial Sequence
  neuraminidase__InfluenzaA__ACZ81542
MNPNQKVITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17751 - protein, 470 aa, Artificial Sequence
  neuraminidase__InfluenzaA__ACZ81543
MNPNQKIITIGSISIAIGIISLMLQIGNIISIWASHSIQTGSQNNTGICNQRIITYENNTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKEQILRTQESECVCMNGSCFTIMTDGPSNKAASYKIFKIEKGKVTKSIELNAPNFYYEECSCYPDTGIVMCVCRDNWHGSNRPWVSFNQNLDYQTGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17752 - protein, 469 aa, Artificial Sequence
  neuraminidase__InfluenzaA__ACZ81546
MNPNQKIITIGSVSLTISTICFFMQIAILITTVTLHFKQYEFNSPPNNQVMLCEPTIIERNITEIVYLTNTTIEKEICPKLAEYRNWSKPQCDITGSAPFSKDNSIRLSAGGDIWVTREPYVSCDPDKCYQFALGQGTTLNNVHSNNTVHDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 17753 - protein, 469 aa, Artificial Sequence
  neuraminidase__InfluenzaA__ACZ81547
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINTKDHSIVSSYVCSGLVGDTPRKNDSSSSSHCLDPNNEEGGHGVKGWAFDDGNDVWMGRTISEKSRLGYETFKVIEGWSNPKSKLQINRQVIVDKGNRSGYSGIFSVEGKSCINRCFYVELIRGRKEETEVLWTSNSIVVFCGTSGTYGTGSWPDGADINLMPI

SEQ ID NO: 17754 - protein, 469 aa, Artificial Sequence; identical to SEQ ID NO: 16738
  neuraminidase__InfluenzaA__ACZ81634

SEQ ID NO: 17755 - protein, 469 aa, Artificial Sequence
  neuraminidase__InfluenzaA__ACZ81644
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 17756 - protein, 469 aa, Artificial Sequence
  neuraminidase__InfluenzaA__ACZ81653
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLNCIRPCFWVELIRGRPKENTIWTSGSSISFCGVNSDTVGWSWPDGAELPFTIDK

SEQ ID NO: 17757 - protein, 469 aa, Artificial Sequence; identical to SEQ ID NO: 16738
  neuraminidase__InfluenzaA__ACZ95840

SEQ ID NO: 17758 - protein, 469 aa, Artificial Sequence; identical to SEQ ID NO: 16738
  neuraminidase__InfluenzaA__ACZ95850

SEQ ID NO: 17759 - protein, 469 aa, Artificial Sequence; identical to SEQ ID NO: 16738
  neuraminidase__InfluenzaA__ACZ95860

SEQ ID NO: 17760 - protein, 469 aa, Artificial Sequence; identical to SEQ ID NO: 16738
  neuraminidase__InfluenzaA__ACZ95870

SEQ ID NO: 17761 - protein, 469 aa, Artificial Sequence; identical to SEQ ID NO: 16738
  neuraminidase__InfluenzaA__ACZ95880

SEQ ID NO: 17762 - protein, 469 aa, Artificial Sequence; identical to SEQ ID NO: 16738
  neuraminidase__InfluenzaA__ACZ95890

SEQ ID NO: 17763 - protein, 469 aa, Artificial Sequence; identical to SEQ ID NO: 16738
  neuraminidase__InfluenzaA__ACZ95900

SEQ ID NO: 17764 - protein, 469 aa, Artificial Sequence; identical to SEQ ID NO: 16738
  neuraminidase__InfluenzaA__ACZ95910

SEQ ID NO: 17765 - protein, 469 aa, Artificial Sequence; identical to SEQ ID NO: 16738
  neuraminidase__InfluenzaA__ACZ95920

SEQ ID NO: 17766 - protein, 469 aa, Artificial Sequence; identical to SEQ ID NO: 17625
  neuraminidase__InfluenzaA__ACZ95930

SEQ ID NO: 17767 - protein, 469 aa, Artificial Sequence; identical to SEQ ID NO: 16738
  neuraminidase__InfluenzaA__ACZ95940

SEQ ID NO: 17768 - protein, 469 aa, Artificial Sequence; identical to SEQ ID NO: 17755
  neuraminidase__InfluenzaA__ACZ95950

SEQ ID NO: 17769 - protein, 469 aa, Artificial Sequence; identical to SEQ ID NO: 16738
  neuraminidase__InfluenzaA__ACZ95960

SEQ ID NO: 17770 - protein, 469 aa, Artificial Sequence; identical to SEQ ID NO: 17755
  neuraminidase__InfluenzaA__ACZ95970

SEQ ID NO: 17771 - protein, 469 aa, Artificial Sequence; identical to SEQ ID NO: 16738
  neuraminidase__InfluenzaA__ACZ95980

SEQ ID NO: 17772 - protein, 469 aa, Artificial Sequence; identical to SEQ ID NO: 16738
  neuraminidase__InfluenzaA__ACZ95990

SEQ ID NO: 17773 - protein, 469 aa, Artificial Sequence; identical to SEQ ID NO: 16738
  neuraminidase__InfluenzaA__ACZ96000

SEQ ID NO: 17774 - protein, 469 aa, Artificial Sequence; identical to SEQ ID NO: 16738
  neuraminidase__InfluenzaA__ACZ96010

SEQ ID NO: 17775 - protein, 469 aa, Artificial Sequence
  neuraminidase__InfluenzaA__ACZ96020
MNPNQKIITIGSVCMTIGMANLILQIGNIILIWISHSIQLGNQNQTETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPIDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17776 - protein, 469 aa, Artificial Sequence; identical to SEQ ID NO: 16738
  neuraminidase__InfluenzaA__ACZ96050

SEQ ID NO: 17777 - protein, 469 aa, Artificial Sequence; identical to SEQ ID NO: 16738
  neuraminidase__InfluenzaA__ACZ96060

SEQ ID NO: 17778 - protein, 469 aa, Artificial Sequence; identical to SEQ ID NO: 16738
  neuraminidase__InfluenzaA__ACZ96072

SEQ ID NO: 17779 - protein, 469 aa, Artificial Sequence; identical to SEQ ID NO: 16738
  neuraminidase__InfluenzaA__ACZ96082

SEQ ID NO: 17780 - protein, 469 aa, Artificial Sequence; identical to SEQ ID NO: 16738
  neuraminidase__InfluenzaA__ACZ96092

SEQ ID NO: 17781 - protein, 469 aa, Artificial Sequence; identical to SEQ ID NO: 16738
  neuraminidase__InfluenzaA__ACZ96102

SEQ ID NO: 17782 - protein, 469 aa, Artificial Sequence; identical to SEQ ID NO: 16738
  neuraminidase__InfluenzaA__ACZ96112

SEQ ID NO: 17783 - protein, 469 aa, Artificial Sequence
  neuraminidase__InfluenzaA__ACZ96122
MNPNQKIITIGSVCMTIGMANLILQIGNIISIWISHSIQLGNQNQIEACNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGKDNNFSIKQDIVGINEWSGYSGSFVQHPELTGLDCIRPCFWVELIRGRPKENTIWTSGSSISFCGINSDTVGWSWPDGAELPFTIDK

SEQ ID NO: 17784 - protein, 469 aa, Artificial Sequence; identical to SEQ ID NO: 16738
  neuraminidase__InfluenzaA__ACZ96132

SEQ ID NO: 17785 - protein, 469 aa, Artificial Sequence; identical to SEQ ID NO: 16738
  neuraminidase__InfluenzaA__ACZ96142

SEQ ID NO: 17786 - protein, 469 aa, Artificial Sequence; identical to SEQ ID NO: 16738
  neuraminidase__InfluenzaA__ACZ96152

SEQ ID NO: 17787 - protein, 469 aa, Artificial Sequence; identical to SEQ ID NO: 16738
  neuraminidase__InfluenzaA__ACZ96162

SEQ ID NO: 17788 - protein, 469 aa, Artificial Sequence; identical to SEQ ID NO: 16738
  neuraminidase__InfluenzaA__ACZ96172

SEQ ID NO: 17789 - protein, 469 aa, Artificial Sequence
  neuraminidase__InfluenzaA__ACZ96182
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDRHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17790 - protein, 469 aa, Artificial Sequence
  neuraminidase__InfluenzaA__ACZ96192
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRSNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17791 - protein, 469 aa, Artificial Sequence
  neuraminidase__InfluenzaA__ACZ96232
MNPNQKIITIGSVCMTVGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNDFSIKQDIVGINEWSGYSGSFVQHPELTGLDCIRPCFWVELIRGRPKENTIWTSGSSISFCGVNSDTVGWSWPDGAELPFTIDK

SEQ ID NO: 17792 - protein, 469 aa, Artificial Sequence
  neuraminidase__InfluenzaA__ACZ96242
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKESTIWTSGSSISFCGVNSDTVGWSWPDGAELPFTIDK

SEQ ID NO: 17793 - protein, 469 aa, Artificial Sequence; identical to SEQ ID NO: 16738
  neuraminidase__InfluenzaA__ACZ96252

SEQ ID NO: 17794 - protein, 469 aa, Artificial Sequence; identical to SEQ ID NO: 16738
  neuraminidase__InfluenzaA__ACZ96292

SEQ ID NO: 17795 - protein, 469 aa, Artificial Sequence; identical to SEQ ID NO: 16738
  neuraminidase__InfluenzaA__ACZ96302

SEQ ID NO: 17796 - protein, 469 aa, Artificial Sequence; identical to SEQ ID NO: 16738
  neuraminidase__InfluenzaA__ACZ96312

SEQ ID NO: 17797 - protein, 469 aa, Artificial Sequence
  neuraminidase__InfluenzaA__ACZ96322
MNPNQKIITIGSVCMTIGMANLILQIGNIISIWISHSIQLGNQNQIETCNQSVITYENNTWVNQTYVNISNTNFAAGQSVVSVKLTGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17798 - protein, 469 aa, Artificial Sequence; identical to SEQ ID NO: 17797
  neuraminidase__InfluenzaA__ACZ96332

SEQ ID NO: 17799 - protein, 469 aa, Artificial Sequence; identical to SEQ ID NO: 16738
  neuraminidase__InfluenzaA__ACZ96352

SEQ ID NO: 17800 - protein, 469 aa, Artificial Sequence; identical to SEQ ID NO: 17797
  neuraminidase__InfluenzaA__ACZ96362

SEQ ID NO: 17801 - protein, 469 aa, Artificial Sequence; identical to SEQ ID NO: 16738
  neuraminidase__InfluenzaA__ACZ96375

SEQ ID NO: 17802 - protein, 469 aa, Artificial Sequence; identical to SEQ ID NO: 17797
  neuraminidase__InfluenzaA__ACZ96385

SEQ ID NO: 17803 - protein, 469 aa, Artificial Sequence
  neuraminidase__InfluenzaA__ACZ96395
MNPNQKIITIGSVCMTIGMANLILQIGNIISIWISHSIQLGNQNQTETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPIDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17804 - protein, 469 aa, Artificial Sequence; identical to SEQ ID NO: 16738
  neuraminidase__InfluenzaA__ACZ96408

SEQ ID NO: 17805 - protein, 469 aa, Artificial Sequence; identical to SEQ ID NO: 16738
  neuraminidase__InfluenzaA__ACZ96428

SEQ ID NO: 17806 - protein, 469 aa, Artificial Sequence; identical to SEQ ID NO: 16738
  neuraminidase__InfluenzaA__ACZ96438

SEQ ID NO: 17807 - protein, 469 aa, Artificial Sequence; identical to SEQ ID NO: 16738
  neuraminidase__InfluenzaA__ACZ96448

SEQ ID NO: 17808 - protein, 469 aa, Artificial Sequence; identical to SEQ ID NO: 16738
  neuraminidase__InfluenzaA__ACZ96479

SEQ ID NO: 17809 - protein, 469 aa, Artificial Sequence; identical to SEQ ID NO: 17755
  neuraminidase__InfluenzaA__ACZ96489

SEQ ID NO: 17810 - protein, 469 aa, Artificial Sequence; identical to SEQ ID NO: 16738
  neuraminidase__InfluenzaA__ACZ96499

SEQ ID NO: 17811 - protein, 469 aa, Artificial Sequence
  neuraminidase__InfluenzaA__ACZ96509
MNPNQKIITIGSVCMTIGMANLILQIGNIISIWISHSIQLGNQNQIETCNQSVITYENNTWINQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17812 - protein, 469 aa, Artificial Sequence; identical to SEQ ID NO: 16738
  neuraminidase__InfluenzaA__ACZ96519

SEQ ID NO: 17813 - protein, 469 aa, Artificial Sequence; identical to SEQ ID NO: 16738
  neuraminidase__InfluenzaA__ACZ96529

SEQ ID NO: 17814 - protein, 469 aa, Artificial Sequence
  neuraminidase__InfluenzaA__ACZ96552
MNPNQKIITIGSVCMTIGMANLILQIGNIISIWISHSSQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17815 - protein, 469 aa, Artificial Sequence; identical to SEQ ID NO: 16738
  neuraminidase__InfluenzaA__ACZ96562

SEQ ID NO: 17816 - protein, 469 aa, Artificial Sequence; identical to SEQ ID NO: 16738
  neuraminidase__InfluenzaA__ACZ96572

SEQ ID NO: 17817 - protein, 469 aa, Artificial Sequence; identical to SEQ ID NO: 16738
  neuraminidase__InfluenzaA__ACZ96582

SEQ ID NO: 17818 - protein, 469 aa, Artificial Sequence
  neuraminidase__InfluenzaA__ACZ96592
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQSSYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17819 - protein, 469 aa, Artificial Sequence; identical to SEQ ID NO: 16738
  neuraminidase__InfluenzaA__ACZ96602

SEQ ID NO: 17820 - protein, 469 aa, Artificial Sequence
  neuraminidase__InfluenzaA__ACZ96612
MNPNQKIITIGSVCMTIGMANLILQIGNIISIWISHSIQLGNQNQIETCNQSVVTYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17821 - protein, 469 aa, Artificial Sequence; identical to SEQ ID NO: 16768
  neuraminidase__InfluenzaA__ACZ96622

SEQ ID NO: 17822 - protein, 469 aa, Artificial Sequence; identical to SEQ ID NO: 16768
  neuraminidase__InfluenzaA__ACZ96632

SEQ ID NO: 17823 - protein, 469 aa, Artificial Sequence; identical to SEQ ID NO: 16768
  neuraminidase__InfluenzaA__ACZ96642

SEQ ID NO: 17824 - protein, 469 aa, Artificial Sequence; identical to SEQ ID NO: 16768
  neuraminidase__InfluenzaA__ACZ96652

SEQ ID NO: 17825 - protein, 469 aa, Artificial Sequence; identical to SEQ ID NO: 16768
  neuraminidase__InfluenzaA__ACZ96662

SEQ ID NO: 17826 - protein, 469 aa, Artificial Sequence; identical to SEQ ID NO: 16768
  neuraminidase__InfluenzaA__ACZ96672

SEQ ID NO: 17827 - protein, 469 aa, Artificial Sequence; identical to SEQ ID NO: 16768
  neuraminidase__InfluenzaA__ACZ96682

SEQ ID NO: 17828 - protein, 469 aa, Artificial Sequence; identical to SEQ ID NO: 16768
  neuraminidase__InfluenzaA__ACZ96692

SEQ ID NO: 17829 - protein, 469 aa, Artificial Sequence; identical to SEQ ID NO: 16768
  neuraminidase__InfluenzaA__ACZ96702

SEQ ID NO: 17830 - protein, 469 aa, Artificial Sequence; identical to SEQ ID NO: 16768
  neuraminidase__InfluenzaA__ACZ96712

SEQ ID NO: 17831 - protein, 469 aa, Artificial Sequence; identical to SEQ ID NO: 16768
  neuraminidase__InfluenzaA__ACZ96722

SEQ ID NO: 17832 - protein, 469 aa, Artificial Sequence; identical to SEQ ID NO: 16768
  neuraminidase__InfluenzaA__ACZ96732

SEQ ID NO: 17833 - protein, 469 aa, Artificial Sequence; identical to SEQ ID NO: 16768
  neuraminidase__InfluenzaA__ACZ96742

SEQ ID NO: 17834 - protein, 469 aa, Artificial Sequence; identical to SEQ ID NO: 16728
  neuraminidase__InfluenzaA__ACZ96752

SEQ ID NO: 17835 - protein, 469 aa, Artificial Sequence; identical to SEQ ID NO: 16728
  neuraminidase__InfluenzaA__ACZ96762

SEQ ID NO: 17836 - protein, 469 aa, Artificial Sequence; identical to SEQ ID NO: 16728
  neuraminidase__InfluenzaA__ACZ96772

SEQ ID NO: 17837 - protein, 469 aa, Artificial Sequence; identical to SEQ ID NO: 16728
  neuraminidase__InfluenzaA__ACZ96782

SEQ ID NO: 17838 - protein, 469 aa, Artificial Sequence; identical to SEQ ID NO: 16728
  neuraminidase__InfluenzaA__ACZ96792

SEQ ID NO: 17839 - protein, 469 aa, Artificial Sequence; identical to SEQ ID NO: 16738
  neuraminidase__InfluenzaA__ACZ96802

SEQ ID NO: 17840 - protein, 469 aa, Artificial Sequence; identical to SEQ ID NO: 16738
  neuraminidase__InfluenzaA__ACZ96812

SEQ ID NO: 17841 - protein, 469 aa, Artificial Sequence; identical to SEQ ID NO: 17321
  neuraminidase__InfluenzaA__ACZ96822

SEQ ID NO: 17842 - protein, 469 aa, Artificial Sequence
  neuraminidase__InfluenzaA__ACZ96842
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMIAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17843 - protein, 469 aa, Artificial Sequence; identical to SEQ ID NO: 16738
  neuraminidase__InfluenzaA__ACZ96852

SEQ ID NO: 17844 - protein, 469 aa, Artificial Sequence; identical to SEQ ID NO: 16738
  neuraminidase__InfluenzaA__ACZ96862

SEQ ID NO: 17845 - protein, 469 aa, Artificial Sequence
  neuraminidase__InfluenzaA__ACZ96872
MNPNQKIITIGSVCMTIGMANLILQIGNIISIWISHSIQLGNQNQIETCNQSVITYENNTWVNQTYVNISNTNFAAGQSVVSMKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17846 - protein, 469 aa, Artificial Sequence; identical to SEQ ID NO: 16728
  neuraminidase__InfluenzaA__ACZ96882

SEQ ID NO: 17847 - protein, 469 aa, Artificial Sequence; identical to SEQ ID NO: 17845
  neuraminidase__InfluenzaA__ACZ96892

SEQ ID NO: 17848 - protein, 469 aa, Artificial Sequence; identical to SEQ ID NO: 17845
  neuraminidase__InfluenzaA__ACZ96902

SEQ ID NO: 17849 - protein, 469 aa, Artificial Sequence; identical to SEQ ID NO: 16728
  neuraminidase__InfluenzaA__ACZ96912

SEQ ID NO: 17850 - protein, 469 aa, Artificial Sequence; identical to SEQ ID NO: 16728
  neuraminidase__InfluenzaA__ACZ96922

SEQ ID NO: 17851 - protein, 469 aa, Artificial Sequence; identical to SEQ ID NO: 17845
  neuraminidase__InfluenzaA__ACZ96932

SEQ ID NO: 17852 - protein, 469 aa, Artificial Sequence; identical to SEQ ID NO: 17845
  neuraminidase__InfluenzaA__ACZ96942

SEQ ID NO: 17853 - protein, 469 aa, Artificial Sequence; identical to SEQ ID NO: 16728
  neuraminidase__InfluenzaA__ACZ96952

SEQ ID NO: 17854 - protein, 469 aa, Artificial Sequence; identical to SEQ ID NO: 16728
  neuraminidase__InfluenzaA__ACZ97024

SEQ ID NO: 17855 - protein, 469 aa, Artificial Sequence; identical to SEQ ID NO: 17845
  neuraminidase__InfluenzaA__ACZ97336

SEQ ID NO: 17856 - protein, 469 aa, Artificial Sequence; identical to SEQ ID NO: 17845
  neuraminidase__InfluenzaA__ACZ97346

SEQ ID NO: 17857 - protein, 469 aa, Artificial Sequence; identical to SEQ ID NO: 16738
  neuraminidase__InfluenzaA__ACZ97366

SEQ ID NO: 17858 - protein, 469 aa, Artificial Sequence; identical to SEQ ID NO: 16738
  neuraminidase__InfluenzaA__ACZ97376

SEQ ID NO: 17859 - protein, 469 aa, Artificial Sequence; identical to SEQ ID NO: 16738
  neuraminidase__InfluenzaA__ACZ97386

SEQ ID NO: 17860 - protein, 469 aa, Artificial Sequence; identical to SEQ ID NO: 17845
  neuraminidase__InfluenzaA__ACZ97396

SEQ ID NO: 17861 - protein, 469 aa, Artificial Sequence; identical to SEQ ID NO: 16738
  neuraminidase__InfluenzaA__ACZ98171

SEQ ID NO: 17862 - protein, 469 aa, Artificial Sequence; identical to SEQ ID NO: 16738
  neuraminidase__InfluenzaA__ACZ98181

SEQ ID NO: 17863 - protein, 469 aa, Artificial Sequence
  neuraminidase__InfluenzaA__ACZ98191
MNPNQKIITIGSVCMTIGMANLILQIGNIISIWISHSIQLGNQNQIETCNQSVISYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17864 - protein, 469 aa, Artificial Sequence; identical to SEQ ID NO: 16728
  neuraminidase__InfluenzaA__ACZ98201

SEQ ID NO: 17865 - protein, 469 aa, Artificial Sequence; identical to SEQ ID NO: 16738
  neuraminidase__InfluenzaA__ACZ98211

SEQ ID NO: 17866 - protein, 469 aa, Artificial Sequence; identical to SEQ ID NO: 16738
  neuraminidase__InfluenzaA__ACZ98221

SEQ ID NO: 17867 - protein, 469 aa, Artificial Sequence; identical to SEQ ID NO: 16738
  neuraminidase__InfluenzaA__ACZ98231

SEQ ID NO: 17868 - protein, 469 aa, Artificial Sequence; identical to SEQ ID NO: 16738
  neuraminidase__InfluenzaA__ACZ98241

SEQ ID NO: 17869 - protein, 469 aa, Artificial Sequence; identical to SEQ ID NO: 17715
  neuraminidase__InfluenzaA__ACZ98251

SEQ ID NO: 17870 - protein, 469 aa, Artificial Sequence; identical to SEQ ID NO: 16738
  neuraminidase__InfluenzaA__ACZ98261

SEQ ID NO: 17871 - protein, 469 aa, Artificial Sequence; identical to SEQ ID NO: 16738
  neuraminidase__InfluenzaA__ACZ98271

SEQ ID NO: 17872 - protein, 469 aa, Artificial Sequence; identical to SEQ ID NO: 16738
  neuraminidase__InfluenzaA__ACZ98281

SEQ ID NO: 17873 - protein, 469 aa, Artificial Sequence; identical to SEQ ID NO: 16738
  neuraminidase__InfluenzaA__ACZ98291

SEQ ID NO: 17874 - protein, 469 aa, Artificial Sequence; identical to SEQ ID NO: 16728
  neuraminidase__InfluenzaA__ACZ98301

SEQ ID NO: 17875 - protein, 469 aa, Artificial Sequence
  neuraminidase__InfluenzaA__ACZ98321
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSINSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17876 - protein, 469 aa, Artificial Sequence; identical to SEQ ID NO: 16738
  neuraminidase__InfluenzaA__ACZ98331

SEQ ID NO: 17877 - protein, 469 aa, Artificial Sequence
  neuraminidase__InfluenzaA__ACZ98341
MNPNQKIITIGSVCITIGMANLILQIGNIISIWISHPIQLGNQNQIETCNQSVITYENNTWVNQTYVNISNTNLAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17878 - protein, 469 aa, Artificial Sequence; identical to SEQ ID NO: 16738
  neuraminidase__InfluenzaA__ACZ98351

SEQ ID NO: 17879 - protein, 469 aa, Artificial Sequence; identical to SEQ ID NO: 16738
  neuraminidase__InfluenzaA__ACZ98361

SEQ ID NO: 17880 - protein, 469 aa, Artificial Sequence; identical to SEQ ID NO: 16738
  neuraminidase__InfluenzaA__ACZ98371

SEQ ID NO: 17881 - protein, 469 aa, Artificial Sequence; identical to SEQ ID NO: 16738
  neuraminidase__InfluenzaA__ACZ98381

SEQ ID NO: 17882 - protein, 469 aa, Artificial Sequence; identical to SEQ ID NO: 16738
  neuraminidase__InfluenzaA__ACZ98391

SEQ ID NO: 17883 - protein, 469 aa, Artificial Sequence; identical to SEQ ID NO: 16738
  neuraminidase__InfluenzaA__ACZ98401

SEQ ID NO: 17884 - protein, 469 aa, Artificial Sequence; identical to SEQ ID NO: 16738
  neuraminidase__InfluenzaA__ACZ98411

SEQ ID NO: 17885 - protein, 469 aa, Artificial Sequence; identical to SEQ ID NO: 16768
  neuraminidase__InfluenzaA__ACZ98421

SEQ ID NO: 17886 - protein, 469 aa, Artificial Sequence; identical to SEQ ID NO: 16738
  neuraminidase__InfluenzaA__ACZ98431

SEQ ID NO: 17887 - protein, 469 aa, Artificial Sequence; identical to SEQ ID NO: 16738
  neuraminidase__InfluenzaA__ACZ98441

SEQ ID NO: 17888 - protein, 469 aa, Artificial Sequence; identical to SEQ ID NO: 16738
  neuraminidase__InfluenzaA__ACZ98451

SEQ ID NO: 17889 - protein, 469 aa, Artificial Sequence; identical to SEQ ID NO: 16738
  neuraminidase__InfluenzaA__ACZ98461

SEQ ID NO: 17890 - protein, 469 aa, Artificial Sequence; identical to SEQ ID NO: 17321
  neuraminidase__InfluenzaA__ACZ98674

SEQ ID NO: 17891 - protein, 469 aa, Artificial Sequence; identical to SEQ ID NO: 17845
  neuraminidase__InfluenzaA__ACZ98684

SEQ ID NO: 17892 - protein, 469 aa, Artificial Sequence; identical to SEQ ID NO: 17791
  neuraminidase__InfluenzaA__ACZ98694

SEQ ID NO: 17893 - protein, 469 aa, Artificial Sequence; identical to SEQ ID NO: 16738
  neuraminidase__InfluenzaA__ADA60801

SEQ ID NO: 17894 - protein, 469 aa, Artificial Sequence; identical to SEQ ID NO: 16738
  neuraminidase__InfluenzaA__ADA69294

SEQ ID NO: 17895 - protein, 469 aa, Artificial Sequence; identical to SEQ ID NO: 16738
  neuraminidase__InfluenzaA__ADA69304

SEQ ID NO: 17896 - protein, 469 aa, Artificial Sequence; identical to SEQ ID NO: 16738
  neuraminidase__InfluenzaA__ADA69314

SEQ ID NO: 17897 - protein, 469 aa, Artificial Sequence; identical to SEQ ID NO: 16738
  neuraminidase__InfluenzaA__ADA69324

SEQ ID NO: 17898 - protein, 469 aa, Artificial Sequence; identical to SEQ ID NO: 16738
  neuraminidase__InfluenzaA__ADA69334

SEQ ID NO: 17899 - protein, 469 aa, Artificial Sequence; identical to SEQ ID NO: 16738
  neuraminidase__InfluenzaA__ADA69451

SEQ ID NO: 17900 - protein, 469 aa, Artificial Sequence; identical to SEQ ID NO: 16738
  neuraminidase__InfluenzaA__ADA69453

SEQ ID NO: 17901 - protein, 469 aa, Artificial Sequence
  neuraminidase__InfluenzaA__ADA71153
MNPNQKIITIGSVSLTISTICFFMQIAILVTTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDPPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 17902 - protein, 470 aa, Artificial Sequence
  neuraminidase__InfluenzaA__ADA71155
MNPNQKIITIGSISIAIGIISLMLQIGNIISIWASHSIQIGSQNNTGICNQRIITYENSTWVNHTYVNINNTKVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17903 - protein, 470 aa, Artificial Sequence; identical to SEQ ID NO: 17461
  neuraminidase__InfluenzaA__ADA71157

SEQ ID NO: 17904 - protein, 470 aa, Artificial Sequence
  neuraminidase__InfluenzaA__ADA71159
MNPNQKIITIGSISIAIGIISLMLQIGNIISIWASHSIQIGSQNNTGICNQRIITYENSTWVNHTYVNINNTKVVAGEGKTSVTLAGNSSLCSISGWAINTKDNSIRIGSKGDVFVIREPFISCSHLECRTFFLTQGALLNDKHSNRTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17905 - protein, 469 aa, Artificial Sequence
  neuraminidase__InfluenzaA__ADA71161
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 17906 - protein, 470 aa, Artificial Sequence
  neuraminidase__InfluenzaA__ADA71165
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKISKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17907 - protein, 469 aa, Artificial Sequence
  neuraminidase__InfluenzaA__ADA71167
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRGRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLNPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 17908 - protein, 470 aa, Artificial Sequence
  neuraminidase__InfluenzaA__ADA71169
MNPNQKIITIGSISIAIGIISLMLQIGNIISIWASHSIQTGSQNHTGICNQRIITYENSTWVNHTYVNINNTNVVAGKDKTPVTLVGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYKGIITGTIKSWKKQILRTQESECVCINGSCFTIMTDGPSDGAASYKIFKIEKGKVTKSMELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNGDIANWSWPDGAELPFTIDK

SEQ ID NO: 17909 - protein, 470 aa, Artificial Sequence; identical to SEQ ID NO: 17461
  neuraminidase__InfluenzaA__ADA71171

SEQ ID NO: 17910 - protein, 469 aa, Artificial Sequence
  neuraminidase__InfluenzaA__ADA71173
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRARTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLNPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 17911 - protein, 470 aa, Artificial Sequence
  neuraminidase__InfluenzaA__ADA71175
MNPNQKIITIGSISIAIGIISLMLQIGNIISIWASHSIQIGSQNNTGICNQRIITYENSTWVNHTYVNINNTKVVAGEDKTSVTLAGNSSLCSISGWAINTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 17912 - protein, 470 aa, Artificial Sequence; identical to SEQ ID NO: 17461
  neuraminidase__InfluenzaA__ADA71177

SEQ ID NO: 17913 - protein, 469 aa, Artificial Sequence
  neuraminidase__InfluenzaA__ADA71193
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKVVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17914 - protein, 469 aa, Artificial Sequence
  neuraminidase__InfluenzaA__ADA79589
MNPNQKIITIGSVCMTIGMANLILQIGNIISIWISHSIQLGNQNQIETCNQSVITYENNTWVNQTYVNISNTNFAAGQSVVSVKLAGSSSLCPVSGWAIYSKDNSIRIGSKGDVFVIREPFISCSPLECRTFFLTQGALLNDKHSNGTIKDRSPYRTLMSCPIGEVPSPYKSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17915 - protein, 469 aa, Artificial Sequence
  neuraminidase__InfluenzaA__ADA79599
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 17916 - protein, 469 aa, Artificial Sequence; identical to SEQ ID NO: 17915
  neuraminidase__InfluenzaA__ADA79609

SEQ ID NO: 17917 - protein, 469 aa, Artificial Sequence
  neuraminidase__InfluenzaA__ADA79619
MNPNQKIITIGSICMTIGMANLILQIGNIISIWISHSIQLGNQNQIETCNQSVITYENNTWVNQTYVNISNTNFAAGQSVASVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17918 - protein, 469 aa, Artificial Sequence; identical to SEQ ID NO: 16738
  neuraminidase__InfluenzaA__ADA81211

SEQ ID NO: 17919 - protein, 469 aa, Artificial Sequence
  neuraminidase__InfluenzaA__ADA83035
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECSTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17920 - protein, 469 aa, Artificial Sequence
  neuraminidase__InfluenzaA__ADA83037
MNPNQKIITIGSVCMTIGMANLILQIGNIISIWISHSIQLGNQDQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 17921 - protein, 469 aa, Artificial Sequence; identical to SEQ ID NO: 16738
  neuraminidase__InfluenzaA__ADA83588

SEQ ID NO: 17922 - protein, 469 aa, Artificial Sequence; identical to SEQ ID NO: 16738
  neuraminidase__InfluenzaA__ADA83592

SEQ ID NO: 17923 - protein, 469 aa, Artificial Sequence; identical to SEQ ID NO: 16738
  neuraminidase__InfluenzaA__ADA83596

SEQ ID NO: 17924 - protein, 469 aa, Artificial Sequence; identical to SEQ ID NO: 16738
  neuraminidase__InfluenzaA__ADA83600

SEQ ID NO: 17925 - protein, 469 aa, Artificial Sequence; identical to SEQ ID NO: 16738
  neuraminidase__InfluenzaA__ADA83604

SEQ ID NO: 17926 - protein, 469 aa, Artificial Sequence; identical to SEQ ID NO: 16738
  neuraminidase__InfluenzaA__ADA83608

SEQ ID NO: 17927 - protein, 469 aa, Artificial Sequence; identical to SEQ ID NO: 16738
  neuraminidase__InfluenzaA__ADA83612

SEQ ID NO: 17928 - protein, 469 aa, Artificial Sequence; identical to SEQ ID NO: 17092
  neuraminidase__InfluenzaA__ADA83616

SEQ ID NO: 17929 - protein, 469 aa, Artificial Sequence; identical to SEQ ID NO: 16738
  neuraminidase__InfluenzaA__ADA83624

SEQ ID NO: 17930 - protein, 469 aa, Artificial Sequence; identical to SEQ ID NO: 16738
  neuraminidase__InfluenzaA__ADA83630

SEQ ID NO: 17931 - protein, 469 aa, Artificial Sequence; identical to SEQ ID NO: 16738
  neuraminidase__InfluenzaA__ADA83634

SEQ ID NO: 17932 - protein, 469 aa, Artificial Sequence; identical to SEQ ID NO: 16738
  neuraminidase__InfluenzaA__ADA83638

SEQ ID NO: 17933 - protein, 469 aa, Artificial Sequence; identical to SEQ ID NO: 16738
  neuraminidase__InfluenzaA__ADA83642

SEQ ID NO: 17934 - protein, 469 aa, Artificial Sequence; identical to SEQ ID NO: 16738
  neuraminidase__InfluenzaA__ADA83649

SEQ ID NO: 17935 - protein, 469 aa, Artificial Sequence; identical to SEQ ID NO: 16738
  neuraminidase__InfluenzaA__ADA83653

SEQ ID NO: 17936 - protein, 469 aa, Artificial Sequence; identical to SEQ ID NO: 16738
  neuraminidase__InfluenzaA__ADA83657

SEQ ID NO: 17937 - protein, 469 aa, Artificial Sequence; identical to SEQ ID NO: 16738
  neuraminidase__InfluenzaA__ADA83661

SEQ ID NO: 17938 - protein, 469 aa, Artificial Sequence; identical to SEQ ID NO: 16738
  neuraminidase__InfluenzaA__ADA83669

SEQ ID NO: 17939 - protein, 469 aa, Artificial Sequence; identical to SEQ ID NO: 16738
  neuraminidase__InfluenzaA__ADA83673

SEQ ID NO: 17940 - protein, 469 aa, Artificial Sequence; identical to SEQ ID NO: 16738
  neuraminidase__InfluenzaA__ADA83677

SEQ ID NO: 17941 - protein, 469 aa, Artificial Sequence; identical to SEQ ID NO: 16738
  neuraminidase__InfluenzaA__ADA83681

SEQ ID NO: 17942 - protein, 469 aa, Artificial Sequence; identical to SEQ ID NO: 16738
  neuraminidase__InfluenzaA__ADA83685

SEQ ID NO: 17943 - protein, 469 aa, Artificial Sequence; identical to SEQ ID NO: 16738
  neuraminidase__InfluenzaA__ADA86069

SEQ ID NO: 17944 - protein, 469 aa, Artificial Sequence; identical to SEQ ID NO: 16738
  neuraminidase__InfluenzaA__ADB27973

SEQ ID NO: 17945 - protein, 469 aa, Artificial Sequence; identical to SEQ ID NO: 16738
  neuraminidase__InfluenzaA__ADB27983

SEQ ID NO: 17946 - protein, 469 aa, Artificial Sequence
  neuraminidase__InfluenzaA__ADB66693
MNPNQKIITIGSVCMTIGMANLILQIGNIISIWIIHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17947 - protein, 469 aa, Artificial Sequence; identical to SEQ ID NO: 16738
  neuraminidase__InfluenzaA__ADB66695

SEQ ID NO: 17948 - protein, 469 aa, Artificial Sequence; identical to SEQ ID NO: 16738
  neuraminidase__InfluenzaA__ADB66696

SEQ ID NO: 17949 - protein, 469 aa, Artificial Sequence
  neuraminidase__InfluenzaA__ADB66697
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDEQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIVGIHEWSGYSGSFVQHPELTGLDCIRPCFWVELIRGRPKENTIWTSGSSISFCGVNSDTVGWSWPDGAELPFTIDK

SEQ ID NO: 17950 - protein, 469 aa, Artificial Sequence; identical to SEQ ID NO: 17913
  neuraminidase__InfluenzaA__ADB81401

SEQ ID NO: 17951 - protein, 469 aa, Artificial Sequence; identical to SEQ ID NO: 17756
  neuraminidase__InfluenzaA__ADB81421

SEQ ID NO: 17952 - protein, 469 aa, Artificial Sequence; identical to SEQ ID NO: 17092
  neuraminidase__InfluenzaA__ADB81431

SEQ ID NO: 17953 - protein, 469 aa, Artificial Sequence; identical to SEQ ID NO: 16738
  neuraminidase__InfluenzaA__ADB81441

SEQ ID NO: 17954 - protein, 469 aa, Artificial Sequence
  neuraminidase__InfluenzaA__ADB81451
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECVCVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 17955 - protein, 469 aa, Artificial Sequence; identical to SEQ ID NO: 17915
  neuraminidase__InfluenzaA__ADB81461

SEQ ID NO: 17956 - protein, 469 aa, Artificial Sequence; identical to SEQ ID NO: 17915
  neuraminidase__InfluenzaA__ADB82942

SEQ ID NO: 17957 - protein, 469 aa, Artificial Sequence; identical to SEQ ID NO: 16893
  neuraminidase__InfluenzaA__ADB82945

SEQ ID NO: 17958 - protein, 469 aa, Artificial Sequence; identical to SEQ ID NO: 16738
  neuraminidase__InfluenzaA__ADB89132

SEQ ID NO: 17959 - protein, 469 aa, Artificial Sequence; identical to SEQ ID NO: 17321
  neuraminidase__InfluenzaA__ADB89142

SEQ ID NO: 17960 - protein, 469 aa, Artificial Sequence; identical to SEQ ID NO: 16738
  neuraminidase__InfluenzaA__ADB89224

SEQ ID NO: 17961 - protein, 469 aa, Artificial Sequence
  neuraminidase__InfluenzaA__ADB89234
MNPNQKIITIGSVCMTIGMANLILQIGNIISIWISHSIQLGNQNQIETCNQSVITYENNTWVNQTYVNISNTNFAAGQSVVSVKLVGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17962 - protein, 469 aa, Artificial Sequence; identical to SEQ ID NO: 16728
  neuraminidase__InfluenzaA__ADB89244

SEQ ID NO: 17963 - protein, 469 aa, Artificial Sequence; identical to SEQ ID NO: 16738
  neuraminidase__InfluenzaA__ADB89264

SEQ ID NO: 17964 - protein, 469 aa, Artificial Sequence; identical to SEQ ID NO: 17708
  neuraminidase__InfluenzaA__ADB89274

SEQ ID NO: 17965 - protein, 469 aa, Artificial Sequence; identical to SEQ ID NO: 16893
  neuraminidase__InfluenzaA__ADB89284

SEQ ID NO: 17966 - protein, 469 aa, Artificial Sequence; identical to SEQ ID NO: 16738
  neuraminidase__InfluenzaA__ADB89294

SEQ ID NO: 17967 - protein, 469 aa, Artificial Sequence; identical to SEQ ID NO: 16738
  neuraminidase__InfluenzaA__ADB89304

SEQ ID NO: 17968 - protein, 469 aa, Artificial Sequence; identical to SEQ ID NO: 16738
  neuraminidase__InfluenzaA__ADB89314

SEQ ID NO: 17969 - protein, 469 aa, Artificial Sequence; identical to SEQ ID NO: 16738
  neuraminidase__InfluenzaA__ADB89324

SEQ ID NO: 17970 - protein, 469 aa, Artificial Sequence; identical to SEQ ID NO: 16738
  neuraminidase__InfluenzaA__ADB89334

SEQ ID NO: 17971 - protein, 469 aa, Artificial Sequence; identical to SEQ ID NO: 16738
  neuraminidase__InfluenzaA__ADB89344

SEQ ID NO: 17972 - protein, 469 aa, Artificial Sequence; identical to SEQ ID NO: 16738
  neuraminidase__InfluenzaA__ADB89364

SEQ ID NO: 17973 - protein, 469 aa, Artificial Sequence; identical to SEQ ID NO: 16738
  neuraminidase__InfluenzaA__ADB89374

SEQ ID NO: 17974 - protein, 469 aa, Artificial Sequence; identical to SEQ ID NO: 16738
  neuraminidase__InfluenzaA__ADB89384

SEQ ID NO: 17975 - protein, 469 aa, Artificial Sequence; identical to SEQ ID NO: 16738
  neuraminidase__InfluenzaA__ADB89394

SEQ ID NO: 17976 - protein, 469 aa, Artificial Sequence
  neuraminidase__InfluenzaA__ADB89404
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNSILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17977 - protein, 469 aa, Artificial Sequence; identical to SEQ ID NO: 16738
  neuraminidase__InfluenzaA__ADB89414

SEQ ID NO: 17978 - protein, 469 aa, Artificial Sequence; identical to SEQ ID NO: 16738
  neuraminidase__InfluenzaA__ADB89424

SEQ ID NO: 17979 - protein, 469 aa, Artificial Sequence; identical to SEQ ID NO: 16738
  neuraminidase__InfluenzaA__ADB89434

SEQ ID NO: 17980 - protein, 469 aa, Artificial Sequence; identical to SEQ ID NO: 16738
  neuraminidase__InfluenzaA__ADB89444

SEQ ID NO: 17981 - protein, 469 aa, Artificial Sequence
  neuraminidase__InfluenzaA__ADB89454
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPNDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17982 - protein, 469 aa, Artificial Sequence; identical to SEQ ID NO: 16738
  neuraminidase__InfluenzaA__ADB89464

SEQ ID NO: 17983 - protein, 469 aa, Artificial Sequence; identical to SEQ ID NO: 16738
  neuraminidase__InfluenzaA__ADB89484

SEQ ID NO: 17984 - protein, 469 aa, Artificial Sequence; identical to SEQ ID NO: 16738
  neuraminidase__InfluenzaA__ADB89494

SEQ ID NO: 17985 - protein, 469 aa, Artificial Sequence; identical to SEQ ID NO: 16728
  neuraminidase__InfluenzaA__ADB89504

SEQ ID NO: 17986 - protein, 469 aa, Artificial Sequence; identical to SEQ ID NO: 16738
  neuraminidase__InfluenzaA__ADB89514

SEQ ID NO: 17987 - protein, 469 aa, Artificial Sequence; identical to SEQ ID NO: 16738
  neuraminidase__InfluenzaA__ADB89524

SEQ ID NO: 17988 - protein, 469 aa, Artificial Sequence
  neuraminidase__InfluenzaA__ADB89544
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSLLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17989 - protein, 469 aa, Artificial Sequence; identical to SEQ ID NO: 16738
  neuraminidase__InfluenzaA__ADB89564

SEQ ID NO: 17990 - protein, 469 aa, Artificial Sequence; identical to SEQ ID NO: 16738
  neuraminidase__InfluenzaA__ADB89574

SEQ ID NO: 17991 - protein, 469 aa, Artificial Sequence; identical to SEQ ID NO: 16738
  neuraminidase__InfluenzaA__ADB89594

SEQ ID NO: 17992 - protein, 469 aa, Artificial Sequence; identical to SEQ ID NO: 16738
  neuraminidase__InfluenzaA__ADB89604

SEQ ID NO: 17993 - protein, 469 aa, Artificial Sequence
  neuraminidase__InfluenzaA__ADB89614
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGIWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 17994 - protein, 469 aa, Artificial Sequence; identical to SEQ ID NO: 16738
  neuraminidase__InfluenzaA__ADB89624

SEQ ID NO: 17995 - protein, 469 aa, Artificial Sequence; identical to SEQ ID NO: 16738
  neuraminidase__InfluenzaA__ADB89634

SEQ ID NO: 17996 - protein, 469 aa, Artificial Sequence; identical to SEQ ID NO: 16738
  neuraminidase__InfluenzaA__ADB89644

SEQ ID NO: 17997 - protein, 469 aa, Artificial Sequence; identical to SEQ ID NO: 17756
  neuraminidase__InfluenzaA__ADB89664

SEQ ID NO: 17998 - protein, 469 aa, Artificial Sequence; identical to SEQ ID NO: 16738
  neuraminidase__InfluenzaA__ADB89674

SEQ ID NO: 17999 - protein, 469 aa, Artificial Sequence; identical to SEQ ID NO: 16738
  neuraminidase__InfluenzaA__ADB89684

SEQ ID NO: 18000 - protein, 469 aa, Artificial Sequence
  neuraminidase__InfluenzaA__ADB89694
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFTIKQDIVGINEWSGYSGSFVQHPELTGLDCIRPCFWVELIRGRPKENTIWTSGSSISFCGVNSDTVGWSWPDGAELPFTIDK

SEQ ID NO: 18001 - protein, 469 aa, Artificial Sequence; identical to SEQ ID NO: 16738
  neuraminidase__InfluenzaA__ADB89704

SEQ ID NO: 18002 - protein, 469 aa, Artificial Sequence; identical to SEQ ID NO: 16738
  neuraminidase__InfluenzaA__ADB89714

SEQ ID NO: 18003 - protein, 469 aa, Artificial Sequence; identical to SEQ ID NO: 16599
  neuraminidase__InfluenzaA__ADB89724

SEQ ID NO: 18004 - protein, 469 aa, Artificial Sequence; identical to SEQ ID NO: 16599
  neuraminidase__InfluenzaA__ADB89735

SEQ ID NO: 18005 - protein, 469 aa, Artificial Sequence; identical to SEQ ID NO: 16738
  neuraminidase__InfluenzaA__ADB90357

SEQ ID NO: 18006 - protein, 469 aa, Artificial Sequence; identical to SEQ ID NO: 16738
  neuraminidase__InfluenzaA__ADB90358

SEQ ID NO: 18007 - protein, 469 aa, Artificial Sequence
  neuraminidase__InfluenzaA__ADB90359
MNPNQKIITIGSVCMTIGMANLILQIGNIISIWISHSIQLGNQNQIETCNQSIITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIVGTNEWSGYSGSFVQHPELTGLDCIRPCFWVELIRGRPKENTIWTSGSSISFCGVNSDTVGWSWPDGAELPFTIDK

SEQ ID NO: 18008 - protein, 469 aa, Artificial Sequence; identical to SEQ ID NO: 16738
  neuraminidase__InfluenzaA__ADB90363

SEQ ID NO: 18009 - protein, 469 aa, Artificial Sequence; identical to SEQ ID NO: 17915
  neuraminidase__InfluenzaA__ADB90373

SEQ ID NO: 18010 - protein, 469 aa, Artificial Sequence; identical to SEQ ID NO: 16738
  neuraminidase__InfluenzaA__ADB98137

SEQ ID NO: 18011 - protein, 469 aa, Artificial Sequence; identical to SEQ ID NO: 17092
  neuraminidase__InfluenzaA__ADB98138

SEQ ID NO: 18012 - protein, 469 aa, Artificial Sequence; identical to SEQ ID NO: 16738
  neuraminidase__InfluenzaA__ADB98139

SEQ ID NO: 18013 - protein, 469 aa, Artificial Sequence; identical to SEQ ID NO: 17092
  neuraminidase__InfluenzaA__ADB98140

SEQ ID NO: 18014 - protein, 469 aa, Artificial Sequence; identical to SEQ ID NO: 17092
  neuraminidase__InfluenzaA__ADB98141

SEQ ID NO: 18015 - protein, 469 aa, Artificial Sequence; identical to SEQ ID NO: 16738
  neuraminidase__InfluenzaA__ADC32391

SEQ ID NO: 18016 - protein, 469 aa, Artificial Sequence; identical to SEQ ID NO: 16738
  neuraminidase__InfluenzaA__ADC32392

SEQ ID NO: 18017 - protein, 469 aa, Artificial Sequence; identical to SEQ ID NO: 16738
  neuraminidase__InfluenzaA__ADC32393

SEQ ID NO: 18018 - protein, 469 aa, Artificial Sequence; identical to SEQ ID NO: 16738
  neuraminidase__InfluenzaA__ADC32394

SEQ ID NO: 18019 - protein, 469 aa, Artificial Sequence; identical to SEQ ID NO: 16738
  neuraminidase__InfluenzaA__ADC32395

SEQ ID NO: 18020 - protein, 469 aa, Artificial Sequence; identical to SEQ ID NO: 16738
  neuraminidase__InfluenzaA__ADC32396

SEQ ID NO: 18021 - protein, 469 aa, Artificial Sequence; identical to SEQ ID NO: 16738
  neuraminidase__InfluenzaA__ADC32397

SEQ ID NO: 18022 - protein, 469 aa, Artificial Sequence; identical to SEQ ID NO: 16738
  neuraminidase__InfluenzaA__ADC32398

SEQ ID NO: 18023 - protein, 469 aa, Artificial Sequence; identical to SEQ ID NO: 16738
  neuraminidase__InfluenzaA__ADC32399

SEQ ID NO: 18024 - protein, 469 aa, Artificial Sequence; identical to SEQ ID NO: 16738
  neuraminidase__InfluenzaA__ADC32400

SEQ ID NO: 18025 - protein, 469 aa, Artificial Sequence; identical to SEQ ID NO: 16738
  neuraminidase__InfluenzaA__ADC32401

SEQ ID NO: 18026 - protein, 469 aa, Artificial Sequence
  neuraminidase__InfluenzaA__ADC32404
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18027 - protein, 469 aa, Artificial Sequence
  neuraminidase__InfluenzaA__ADC32407
MNPKQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18028 - protein, 469 aa, Artificial Sequence
  neuraminidase__InfluenzaA__ADC34942
MNPNQKIITIGSVSLTISTICFFMQIAILITTVTLHFKQYEFNPPPNNQVMLCEPTIIERNITEIVYLTNTTIEKEICPKLAEYREWSKPQCNITGFAPFSKDNSIRLSAGGDIWVTREPYVSCDPDKCYQFALGQGTTLNNVHSNDIVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWRGSNRPIVDINMKDYSIVSSYVCSGLVGDTPRKNDSSSSGHCLNPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 18029 - protein, 469 aa, Artificial Sequence
  neuraminidase__InfluenzaA__ADC39000
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDNVGWSWPDGAELPFTIDK

SEQ ID NO: 18030 - protein, 469 aa, Artificial Sequence; identical to SEQ ID NO: 16738
  neuraminidase__InfluenzaA__ADC39010

SEQ ID NO: 18031 - protein, 470 aa, Artificial Sequence; identical to SEQ ID NO: 16632
  neuraminidase__InfluenzaA__ADC45606

SEQ ID NO: 18032 - protein, 470 aa, Artificial Sequence
  neuraminidase__InfluenzaA__ADC45628
MNPNQKIITIGSISIAIGIISLMLQMGNIISIWASHSIQTGSQNHTGICNQRIITYENSTWVNHTYVNINNTNVVAGKDKTPVTLVGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYKGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDREGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNGDIANWSWPDGAELPFTIDK

SEQ ID NO: 18033 - protein, 470 aa, Artificial Sequence
  neuraminidase__InfluenzaA__ADC45639
MNPNQKIITIGSISIAIGIISLMLQIGNIISIWASHSIQTGSQNHTGICNQRIITYENSTWVNHTYVNINNTNVVAGKDKTPVTLVGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGVSGPDNGAVAVLKYKGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDREGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNGDIANWSWPDGAELPFTIDK

SEQ ID NO: 18034 - protein, 470 aa, Artificial Sequence; identical to SEQ ID NO: 16632
  neuraminidase__InfluenzaA__ADC45650

SEQ ID NO: 18035 - protein, 470 aa, Artificial Sequence; identical to SEQ ID NO: 16632
  neuraminidase__InfluenzaA__ADC45661

SEQ ID NO: 18036 - protein, 470 aa, Artificial Sequence
  neuraminidase__InfluenzaA__ADC45683
MNPNQKIITIGSISIAIGIISLMLQIGNIISIWASHSIQTGSQNHTGICNQRIITYENSTWVNHTYVNINNTNVVAGEDKTPVTLVGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYKGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDREGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNGDIANWSWPDGAELPFTIDK

SEQ ID NO: 18037 - protein, 470 aa, Artificial Sequence
  neuraminidase__InfluenzaA__ADC45705
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKNRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 18038 - protein, 470 aa, Artificial Sequence
  neuraminidase__InfluenzaA__ADC45716
MNPNQKIITIGSISIAIGIISLMLQIGNIISIWASHSIQTGSQNHTGICNQRIITYENSTWVNHTYVNINNTNVVAGKDKTPVTLVGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYKGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDREGSCNPVTVDGANGVEGFSYKYGNGVWIGRTKSNRIRKGFEMIWDPNGWTNTDSDFSVKQDIVAITNWSGYSGSFVQHPELTGLDCIRPCFWVELVRGLPRENTTIWTSGSSISFCGVNGDIANWSWPDGAELPFTIDK

SEQ ID NO: 18039 - protein, 470 aa, Artificial Sequence
  neuraminidase__InfluenzaA__ADC45738
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 18040 - protein, 470 aa, Artificial Sequence
  neuraminidase__InfluenzaA__ADC45760
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLGCIRPCFWVELVRGLPRENTTIWTSGSSISFCGVNSDTANWSWPDGAELPFTIDK

SEQ ID NO: 18041 - protein, 470 aa, Artificial Sequence
  neuraminidase__InfluenzaA__ADC45771
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSMKQDVVAITDWSGYSGSFVQHPELTGLDCIRPCFWVELVRGLPRENTTIWTSGSSISFCGVNSDTANWSWPDGAELPFTIDK

SEQ ID NO: 18042 - protein, 470 aa, Artificial Sequence
  neuraminidase__InfluenzaA__ADC45782
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNRTVKDRSPYRALMSCPLGEAPSPYNSKFESVAWSASACHDGMGWLTIGISGPDNGAVAVLKYNGIITGTIKSWKKQILRTQESECVCVNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 18043 - protein, 470 aa, Artificial Sequence
  neuraminidase__InfluenzaA__ADC45804
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKITKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 18044 - protein, 470 aa, Artificial Sequence
  neuraminidase__InfluenzaA__ADC45815
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTVKSWKKQILRTQESECVCMNGSCFTIMTDGPSNKAASYKIFKIEKGKVTKSIELNAPNFYYEECSCYPDTGMVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 18045 - protein, 470 aa, Artificial Sequence; identical to SEQ ID NO: 17461
  neuraminidase__InfluenzaA__ADC45837

SEQ ID NO: 18046 - protein, 470 aa, Artificial Sequence; identical to SEQ ID NO: 17461
  neuraminidase__InfluenzaA__ADC45848

SEQ ID NO: 18047 - protein, 469 aa, Artificial Sequence; identical to SEQ ID NO: 16738
  neuraminidase__InfluenzaA__ADC53559

SEQ ID NO: 18048 - protein, 469 aa, Artificial Sequence; identical to SEQ ID NO: 16738
  neuraminidase__InfluenzaA__ADD14088

SEQ ID NO: 18049 - protein, 469 aa, Artificial Sequence; identical to SEQ ID NO: 16738
  neuraminidase__InfluenzaA__ADD14090

SEQ ID NO: 18050 - protein, 469 aa, Artificial Sequence; identical to SEQ ID NO: 16738
  neuraminidase__InfluenzaA__ADD14094

SEQ ID NO: 18051 - protein, 469 aa, Artificial Sequence; identical to SEQ ID NO: 16738
  neuraminidase__InfluenzaA__ADD14096

SEQ ID NO: 18052 - protein, 469 aa, Artificial Sequence; identical to SEQ ID NO: 16738
  neuraminidase__InfluenzaA__ADD14098

SEQ ID NO: 18053 - protein, 469 aa, Artificial Sequence; identical to SEQ ID NO: 16738
  neuraminidase__InfluenzaA__ADD14100

SEQ ID NO: 18054 - protein, 469 aa, Artificial Sequence; identical to SEQ ID NO: 16738
  neuraminidase__InfluenzaA__ADD14102

SEQ ID NO: 18055 - protein, 469 aa, Artificial Sequence; identical to SEQ ID NO: 16738
  neuraminidase__InfluenzaA__ADD14104

SEQ ID NO: 18056 - protein, 469 aa, Artificial Sequence; identical to SEQ ID NO: 16738
  neuraminidase__InfluenzaA__ADD14106

SEQ ID NO: 18057 - protein, 469 aa, Artificial Sequence; identical to SEQ ID NO: 16738
  neuraminidase__InfluenzaA__ADD14110

SEQ ID NO: 18058 - protein, 469 aa, Artificial Sequence; identical to SEQ ID NO: 16738
  neuraminidase__InfluenzaA__ADD14112

SEQ ID NO: 18059 - protein, 469 aa, Artificial Sequence; identical to SEQ ID NO: 17708
  neuraminidase__InfluenzaA__ADD14114

SEQ ID NO: 18060 - protein, 469 aa, Artificial Sequence; identical to SEQ ID NO: 16738
  neuraminidase__InfluenzaA__ADD14116

SEQ ID NO: 18061 - protein, 469 aa, Artificial Sequence; identical to SEQ ID NO: 16738
  neuraminidase__InfluenzaA__ADD14118

SEQ ID NO: 18062 - protein, 469 aa, Artificial Sequence; identical to SEQ ID NO: 16738
  neuraminidase__InfluenzaA__ADD14120

SEQ ID NO: 18063 - protein, 469 aa, Artificial Sequence; identical to SEQ ID NO: 16738
  neuraminidase__InfluenzaA__ADD14122

SEQ ID NO: 18064 - protein, 469 aa, Artificial Sequence; identical to SEQ ID NO: 16738
  neuraminidase__InfluenzaA__ADD14124

SEQ ID NO: 18065 - protein, 469 aa, Artificial Sequence; identical to SEQ ID NO: 17797
  neuraminidase__InfluenzaA__ADD14126

SEQ ID NO: 18066 - protein, 469 aa, Artificial Sequence; identical to SEQ ID NO: 16738
  neuraminidase__InfluenzaA__ADD14128

SEQ ID NO: 18067 - protein, 469 aa, Artificial Sequence; identical to SEQ ID NO: 16738
  neuraminidase__InfluenzaA__ADD14130

SEQ ID NO: 18068 - protein, 469 aa, Artificial Sequence; identical to SEQ ID NO: 16738
  neuraminidase__InfluenzaA__ADD14132

SEQ ID NO: 18069 - protein, 469 aa, Artificial Sequence; identical to SEQ ID NO: 16738
  neuraminidase__InfluenzaA__ADD14134

SEQ ID NO: 18070 - protein, 469 aa, Artificial Sequence; identical to SEQ ID NO: 16738
  neuraminidase__InfluenzaA__ADD14136

SEQ ID NO: 18071 - protein, 469 aa, Artificial Sequence; identical to SEQ ID NO: 16738
  neuraminidase__InfluenzaA__ADD14138

SEQ ID NO: 18072 - protein, 469 aa, Artificial Sequence; identical to SEQ ID NO: 16738
  neuraminidase__InfluenzaA__ADD14142

SEQ ID NO: 18073 - protein, 469 aa, Artificial Sequence; identical to SEQ ID NO: 16738
  neuraminidase__InfluenzaA__ADD14144

SEQ ID NO: 18074 - protein, 469 aa, Artificial Sequence; identical to SEQ ID NO: 16738
  neuraminidase__InfluenzaA__ADD14146

SEQ ID NO: 18075 - protein, 469 aa, Artificial Sequence; identical to SEQ ID NO: 16738
  neuraminidase__InfluenzaA__ADD14148

SEQ ID NO: 18076 - protein, 469 aa, Artificial Sequence
  neuraminidase__InfluenzaA__ADD14150
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDDNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18077 - protein, 469 aa, Artificial Sequence; identical to SEQ ID NO: 16738
  neuraminidase__InfluenzaA__ADD14152

SEQ ID NO: 18078 - protein, 469 aa, Artificial Sequence
  neuraminidase__InfluenzaA__ADD14154
MNPNQKIITIGSVCMTIGMANLILQIGNIISIWISHSIQLGNQNQIETCNQSVITYENNTWVNQTYVNISITNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18079 - protein, 469 aa, Artificial Sequence; identical to SEQ ID NO: 16738
  neuraminidase__InfluenzaA__ADD14156

SEQ ID NO: 18080 - protein, 469 aa, Artificial Sequence; identical to SEQ ID NO: 16738
  neuraminidase__InfluenzaA__ADD14158

SEQ ID NO: 18081 - protein, 469 aa, Artificial Sequence; identical to SEQ ID NO: 16738
  neuraminidase__InfluenzaA__ADD14164

SEQ ID NO: 18082 - protein, 469 aa, Artificial Sequence; identical to SEQ ID NO: 16738
  neuraminidase__InfluenzaA__ADD14174

SEQ ID NO: 18083 - protein, 469 aa, Artificial Sequence; identical to SEQ ID NO: 16738
  neuraminidase__InfluenzaA__ADD14184

SEQ ID NO: 18084 - protein, 469 aa, Artificial Sequence; identical to SEQ ID NO: 16738
  neuraminidase__InfluenzaA__ADD14194

SEQ ID NO: 18085 - protein, 469 aa, Artificial Sequence; identical to SEQ ID NO: 17092
  neuraminidase__InfluenzaA__ADD14204

SEQ ID NO: 18086 - protein, 469 aa, Artificial Sequence
  neuraminidase__InfluenzaA__ADD21449
MNPNQRIITIGTACLIIGIVSLLLQIGNIVSLWISHSIQTGEKNHSETCNRNTITYENSTWVNQTYVNISNINIAGGQGVASIILAGNSSLCPVNGWAIYSKDNSIRIGSKGDIFVIREPFISCSHLECRTFFLTQGALLNDRHSNGTVKDRSPYRTLMSCPIGEAPSPYNSKFESVAWSASACHDGMGWLTIGISGPDNGAVAVLKYNGIITDTIKSWRNRILRTQESECVCINGSCFTIMTDGPSNGQASYKIFKMERGKIIKSVELDAPNYHYEECSCYPDTGKVVCVCRDNWHASNRPWVSFDQNLDYQIGYISSGVFGDNPRSNDGKGNCGPVLSNGANGVKGLSFRYGNGVWIGRTKSTNSRSGFEMIWDPNGWTETDSNFSMKQDIIALTDWSGYSGSFVQHPELTGMNCIRPCFWVELIRGQPKQSTIWTSGSSISFCGVDSETASWSWPDGADLPFTIDK

SEQ ID NO: 18087 - protein, 470 aa, Artificial Sequence
  neuraminidase__InfluenzaA__ADD21469
MNPNQKIITIGSISIAIGIISLMLQIGNIISVWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRMLRTQESECICVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSNFSVKQDVVAITDWSGYSGSFVQHPELTGLDCIRPCFWVELVRGLPRENTTIWTSGSSISFCGVNSDTANWSWPDGAELPFTIDK

SEQ ID NO: 18088 - protein, 469 aa, Artificial Sequence; identical to SEQ ID NO: 16738
  neuraminidase__InfluenzaA__ADD21747

SEQ ID NO: 18089 - protein, 469 aa, Artificial Sequence
  neuraminidase__InfluenzaA__ADD21767
MNPNQKIIIIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18090 - protein, 469 aa, Artificial Sequence
  neuraminidase__InfluenzaA__ADD21777
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVIKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18091 - protein, 469 aa, Artificial Sequence; identical to SEQ ID NO: 16738
  neuraminidase__InfluenzaA__ADD21787

SEQ ID NO: 18092 - protein, 469 aa, Artificial Sequence; identical to SEQ ID NO: 16738
  neuraminidase__InfluenzaA__ADD21797

SEQ ID NO: 18093 - protein, 469 aa, Artificial Sequence; identical to SEQ ID NO: 16738
  neuraminidase__InfluenzaA__ADD21817

SEQ ID NO: 18094 - protein, 469 aa, Artificial Sequence; identical to SEQ ID NO: 16738
  neuraminidase__InfluenzaA__ADD21827

SEQ ID NO: 18095 - protein, 469 aa, Artificial Sequence; identical to SEQ ID NO: 16738
  neuraminidase__InfluenzaA__ADD21837

SEQ ID NO: 18096 - protein, 469 aa, Artificial Sequence; identical to SEQ ID NO: 16738
  neuraminidase__InfluenzaA__ADD21847

SEQ ID NO: 18097 - protein, 469 aa, Artificial Sequence; identical to SEQ ID NO: 16738
  neuraminidase__InfluenzaA__ADD21857

SEQ ID NO: 18098 - protein, 469 aa, Artificial Sequence; identical to SEQ ID NO: 16738
  neuraminidase__InfluenzaA__ADD21867

SEQ ID NO: 18099 - protein, 469 aa, Artificial Sequence; identical to SEQ ID NO: 16738
  neuraminidase__InfluenzaA__ADD21877

SEQ ID NO: 18100 - protein, 469 aa, Artificial Sequence; identical to SEQ ID NO: 16738
  neuraminidase__InfluenzaA__ADD21897

SEQ ID NO: 18101 - protein, 469 aa, Artificial Sequence; identical to SEQ ID NO: 16738
  neuraminidase__InfluenzaA__ADD22494

SEQ ID NO: 18102 - protein, 469 aa, Artificial Sequence; identical to SEQ ID NO: 16738
  neuraminidase__InfluenzaA__ADD22504

SEQ ID NO: 18103 - protein, 469 aa, Artificial Sequence; identical to SEQ ID NO: 16738
  neuraminidase__InfluenzaA__ADD22514

SEQ ID NO: 18104 - protein, 469 aa, Artificial Sequence; identical to SEQ ID NO: 16738
  neuraminidase__InfluenzaA__ADD22524

SEQ ID NO: 18105 - protein, 469 aa, Artificial Sequence
  neuraminidase__InfluenzaA__ADD22534
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDSPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18106 - protein, 469 aa, Artificial Sequence; identical to SEQ ID NO: 16738
  neuraminidase__InfluenzaA__ADD22544

SEQ ID NO: 18107 - protein, 469 aa, Artificial Sequence; identical to SEQ ID NO: 16738
  neuraminidase__InfluenzaA__ADD22557

SEQ ID NO: 18108 - protein, 469 aa, Artificial Sequence; identical to SEQ ID NO: 16738
  neuraminidase__InfluenzaA__ADD22567

SEQ ID NO: 18109 - protein, 469 aa, Artificial Sequence; identical to SEQ ID NO: 16738
  neuraminidase__InfluenzaA__ADD22577

SEQ ID NO: 18110 - protein, 469 aa, Artificial Sequence; identical to SEQ ID NO: 16738
  neuraminidase__InfluenzaA__ADD22587

SEQ ID NO: 18111 - protein, 469 aa, Artificial Sequence; identical to SEQ ID NO: 16738
  neuraminidase__InfluenzaA__ADD22597

SEQ ID NO: 18112 - protein, 469 aa, Artificial Sequence; identical to SEQ ID NO: 16738
  neuraminidase__InfluenzaA__ADD22617

SEQ ID NO: 18113 - protein, 469 aa, Artificial Sequence; identical to SEQ ID NO: 16738
  neuraminidase__InfluenzaA__ADD22627

SEQ ID NO: 18114 - protein, 469 aa, Artificial Sequence; identical to SEQ ID NO: 16738
  neuraminidase__InfluenzaA__ADD22637

SEQ ID NO: 18115 - protein, 469 aa, Artificial Sequence; identical to SEQ ID NO: 16738
  neuraminidase__InfluenzaA__ADD22648

SEQ ID NO: 18116 - protein, 469 aa, Artificial Sequence; identical to SEQ ID NO: 16738
  neuraminidase__InfluenzaA__ADD22658

SEQ ID NO: 18117 - protein, 469 aa, Artificial Sequence; identical to SEQ ID NO: 16738
  neuraminidase__InfluenzaA__ADD22668

SEQ ID NO: 18118 - protein, 469 aa, Artificial Sequence
  neuraminidase__InfluenzaA__ADD22688
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWIELIRGRPKENTIWTSGSSISFCGVNSDTVGWSWPDGAELPFTIDK

SEQ ID NO: 18119 - protein, 469 aa, Artificial Sequence; identical to SEQ ID NO: 16738
  neuraminidase__InfluenzaA__ADD22698

SEQ ID NO: 18120 - protein, 469 aa, Artificial Sequence; identical to SEQ ID NO: 16738
  neuraminidase__InfluenzaA__ADD22725

SEQ ID NO: 18121 - protein, 469 aa, Artificial Sequence; identical to SEQ ID NO: 16738
  neuraminidase__InfluenzaA__ADD22735

SEQ ID NO: 18122 - protein, 469 aa, Artificial Sequence; identical to SEQ ID NO: 16738
  neuraminidase__InfluenzaA__ADD22745

SEQ ID NO: 18123 - protein, 469 aa, Artificial Sequence
  neuraminidase__InfluenzaA__ADD22755
MNPNQKIITIGSVCMTIGMANLILQIGNIISIWISHSIQLGNQNQIETCNQSVITYENNTWVNQTYVNISNTNFAAGQSVVSVKLAGNSSLCTVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDSPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18124 - protein, 469 aa, Artificial Sequence
  neuraminidase__InfluenzaA__ADD22765
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINDWSGYSGSFVQHPELTGLDCIRPCFWVELIRGRPKENTIWTSGSSISFCGVNSDTVGWSWPDGAELPFTIDK

SEQ ID NO: 18125 - protein, 469 aa, Artificial Sequence; identical to SEQ ID NO: 16738
  neuraminidase__InfluenzaA__ADD22775

SEQ ID NO: 18126 - protein, 469 aa, Artificial Sequence; identical to SEQ ID NO: 16738
  neuraminidase__InfluenzaA__ADD22785

SEQ ID NO: 18127 - protein, 469 aa, Artificial Sequence; identical to SEQ ID NO: 16738
  neuraminidase__InfluenzaA__ADD22795

SEQ ID NO: 18128 - protein, 469 aa, Artificial Sequence; identical to SEQ ID NO: 16738
  neuraminidase__InfluenzaA__ADD22805

SEQ ID NO: 18129 - protein, 469 aa, Artificial Sequence; identical to SEQ ID NO: 16738
  neuraminidase__InfluenzaA__ADD22815

SEQ ID NO: 18130 - protein, 469 aa, Artificial Sequence; identical to SEQ ID NO: 16738
  neuraminidase__InfluenzaA__ADD22825

SEQ ID NO: 18131 - protein, 469 aa, Artificial Sequence; identical to SEQ ID NO: 16738
  neuraminidase__InfluenzaA__ADD22835

SEQ ID NO: 18132 - protein, 469 aa, Artificial Sequence; identical to SEQ ID NO: 16738
  neuraminidase__InfluenzaA__ADD22845

SEQ ID NO: 18133 - protein, 469 aa, Artificial Sequence; identical to SEQ ID NO: 16738
  neuraminidase__InfluenzaA__ADD22855

SEQ ID NO: 18134 - protein, 469 aa, Artificial Sequence; identical to SEQ ID NO: 16738
  neuraminidase__InfluenzaA__ADD22924

SEQ ID NO: 18135 - protein, 469 aa, Artificial Sequence; identical to SEQ ID NO: 16738
  neuraminidase__InfluenzaA__ADD22934

SEQ ID NO: 18136 - protein, 469 aa, Artificial Sequence; identical to SEQ ID NO: 16738
  neuraminidase__InfluenzaA__ADD22944

SEQ ID NO: 18137 - protein, 469 aa, Artificial Sequence; identical to SEQ ID NO: 16738
  neuraminidase__InfluenzaA__ADD22954

SEQ ID NO: 18138 - protein, 469 aa, Artificial Sequence; identical to SEQ ID NO: 16738
  neuraminidase__InfluenzaA__ADD22974

SEQ ID NO: 18139 - protein, 469 aa, Artificial Sequence; identical to SEQ ID NO: 16738
  neuraminidase__InfluenzaA__ADD23075

SEQ ID NO: 18140 - protein, 469 aa, Artificial Sequence
  neuraminidase__InfluenzaA__ADD23085
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIRELFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18141 - protein, 469 aa, Artificial Sequence; identical to SEQ ID NO: 16738
  neuraminidase__InfluenzaA__ADD23095

SEQ ID NO: 18142 - protein, 469 aa, Artificial Sequence; identical to SEQ ID NO: 16738
  neuraminidase__InfluenzaA__ADD23105

SEQ ID NO: 18143 - protein, 469 aa, Artificial Sequence; identical to SEQ ID NO: 16738
  neuraminidase__InfluenzaA__ADD23115

SEQ ID NO: 18144 - protein, 469 aa, Artificial Sequence; identical to SEQ ID NO: 16738
  neuraminidase__InfluenzaA__ADD23125

SEQ ID NO: 18145 - protein, 469 aa, Artificial Sequence; identical to SEQ ID NO: 16738
  neuraminidase__InfluenzaA__ADD23135

SEQ ID NO: 18146 - protein, 469 aa, Artificial Sequence; identical to SEQ ID NO: 16738
  neuraminidase__InfluenzaA__ADD23145

SEQ ID NO: 18147 - protein, 469 aa, Artificial Sequence; identical to SEQ ID NO: 16738
  neuraminidase__InfluenzaA__ADD23155

SEQ ID NO: 18148 - protein, 469 aa, Artificial Sequence; identical to SEQ ID NO: 16738
  neuraminidase__InfluenzaA__ADD23165

SEQ ID NO: 18149 - protein, 469 aa, Artificial Sequence; identical to SEQ ID NO: 16738
  neuraminidase__InfluenzaA__ADD23175

SEQ ID NO: 18150 - protein, 469 aa, Artificial Sequence; identical to SEQ ID NO: 16738
  neuraminidase__InfluenzaA__ADD23185

SEQ ID NO: 18151 - protein, 469 aa, Artificial Sequence; identical to SEQ ID NO: 16738
  neuraminidase__InfluenzaA__ADD23195

SEQ ID NO: 18152 - protein, 469 aa, Artificial Sequence; identical to SEQ ID NO: 16738
  neuraminidase__InfluenzaA__ADD23223

SEQ ID NO: 18153 - protein, 469 aa, Artificial Sequence
  neuraminidase__InfluenzaA__ADD23233
MNPNQKIITIGSVCMTIGMANLILQIGNIISIWIGHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18154 - protein, 469 aa, Artificial Sequence; identical to SEQ ID NO: 16738
  neuraminidase__InfluenzaA__ADD23243

SEQ ID NO: 18155 - protein, 469 aa, Artificial Sequence; identical to SEQ ID NO: 18026
  neuraminidase__InfluenzaA__ADD23253

SEQ ID NO: 18156 - protein, 469 aa, Artificial Sequence
  neuraminidase__InfluenzaA__ADD23273
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSEGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18157 - protein, 469 aa, Artificial Sequence; identical to SEQ ID NO: 16738
  neuraminidase__InfluenzaA__ADD23283

SEQ ID NO: 18158 - protein, 469 aa, Artificial Sequence; identical to SEQ ID NO: 16738
  neuraminidase__InfluenzaA__ADD23293

SEQ ID NO: 18159 - protein, 469 aa, Artificial Sequence; identical to SEQ ID NO: 16738
  neuraminidase__InfluenzaA__ADD23303

SEQ ID NO: 18160 - protein, 469 aa, Artificial Sequence; identical to SEQ ID NO: 16738
  neuraminidase__InfluenzaA__ADD23313

SEQ ID NO: 18161 - protein, 469 aa, Artificial Sequence
  neuraminidase__InfluenzaA__ADD23323
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVLTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18162 - protein, 469 aa, Artificial Sequence; identical to SEQ ID NO: 16738
  neuraminidase__InfluenzaA__ADD23333

SEQ ID NO: 18163 - protein, 469 aa, Artificial Sequence; identical to SEQ ID NO: 16738
  neuraminidase__InfluenzaA__ADD23358

SEQ ID NO: 18164 - protein, 469 aa, Artificial Sequence; identical to SEQ ID NO: 18089
  neuraminidase__InfluenzaA__ADD23368

SEQ ID NO: 18165 - protein, 469 aa, Artificial Sequence; identical to SEQ ID NO: 16738
  neuraminidase__InfluenzaA__ADD23378

SEQ ID NO: 18166 - protein, 469 aa, Artificial Sequence; identical to SEQ ID NO: 16738
  neuraminidase__InfluenzaA__ADD23388

SEQ ID NO: 18167 - protein, 469 aa, Artificial Sequence; identical to SEQ ID NO: 17321
  neuraminidase__InfluenzaA__ADD23398

SEQ ID NO: 18168 - protein, 469 aa, Artificial Sequence
  neuraminidase__InfluenzaA__ADD23408
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQDLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18169 - protein, 469 aa, Artificial Sequence
  neuraminidase__InfluenzaA__ADD23438
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNSFSIKQDIVGINEWSGYSGSFVQHPELTGLDCIRPCFWVELIRGRPKENTIWTSGSSISFCGVNSDTVGWSWPDGAELPFTIDK

SEQ ID NO: 18170 - protein, 469 aa, Artificial Sequence; identical to SEQ ID NO: 16738
  neuraminidase__InfluenzaA__ADD23448

SEQ ID NO: 18171 - protein, 469 aa, Artificial Sequence; identical to SEQ ID NO: 16738
  neuraminidase__InfluenzaA__ADD23458

SEQ ID NO: 18172 - protein, 469 aa, Artificial Sequence
  neuraminidase__InfluenzaA__ADD23468
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGVNEWSGYSGSFVQHPELTGLDCIRPCFWVELIRGRPKENTIWTSGSSISFCGVNSDTVGWSWPDGAELPFTIDK

SEQ ID NO: 18173 - protein, 469 aa, Artificial Sequence; identical to SEQ ID NO: 16738
  neuraminidase__InfluenzaA__ADD23478

SEQ ID NO: 18174 - protein, 469 aa, Artificial Sequence; identical to SEQ ID NO: 16738
  neuraminidase__InfluenzaA__ADD23488

SEQ ID NO: 18175 - protein, 469 aa, Artificial Sequence
  neuraminidase__InfluenzaA__ADD23498
MNPNQKIITIGSVCMTIGMANLILQIGNIISIWISHSIQLGNQNHIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18176 - protein, 469 aa, Artificial Sequence; identical to SEQ ID NO: 16738
  neuraminidase__InfluenzaA__ADD23508

SEQ ID NO: 18177 - protein, 469 aa, Artificial Sequence; identical to SEQ ID NO: 16738
  neuraminidase__InfluenzaA__ADD23518

SEQ ID NO: 18178 - protein, 469 aa, Artificial Sequence; identical to SEQ ID NO: 16738
  neuraminidase__InfluenzaA__ADD23997

SEQ ID NO: 18179 - protein, 469 aa, Artificial Sequence; identical to SEQ ID NO: 16738
  neuraminidase__InfluenzaA__ADD24007

SEQ ID NO: 18180 - protein, 469 aa, Artificial Sequence; identical to SEQ ID NO: 16738
  neuraminidase__InfluenzaA__ADD24017

SEQ ID NO: 18181 - protein, 469 aa, Artificial Sequence; identical to SEQ ID NO: 16738
  neuraminidase__InfluenzaA__ADD24024

SEQ ID NO: 18182 - protein, 469 aa, Artificial Sequence; identical to SEQ ID NO: 16738
  neuraminidase__InfluenzaA__ADD24025

SEQ ID NO: 18183 - protein, 469 aa, Artificial Sequence; identical to SEQ ID NO: 16738
  neuraminidase__InfluenzaA__ADD24026

SEQ ID NO: 18184 - protein, 469 aa, Artificial Sequence; identical to SEQ ID NO: 16738
  neuraminidase__InfluenzaA__ADD24027

SEQ ID NO: 18185 - protein, 469 aa, Artificial Sequence; identical to SEQ ID NO: 16738
  neuraminidase__InfluenzaA__ADD24028

SEQ ID NO: 18186 - protein, 469 aa, Artificial Sequence; identical to SEQ ID NO: 16738
  neuraminidase__InfluenzaA__ADD24029

SEQ ID NO: 18187 - protein, 469 aa, Artificial Sequence; identical to SEQ ID NO: 16738
  neuraminidase__InfluenzaA__ADD24030

SEQ ID NO: 18188 - protein, 469 aa, Artificial Sequence; identical to SEQ ID NO: 16738
  neuraminidase__InfluenzaA__ADD24031

SEQ ID NO: 18189 - protein, 469 aa, Artificial Sequence; identical to SEQ ID NO: 16738
  neuraminidase__InfluenzaA__ADD24032

SEQ ID NO: 18190 - protein, 469 aa, Artificial Sequence; identical to SEQ ID NO: 16738
  neuraminidase__InfluenzaA__ADD25231

SEQ ID NO: 18191 - protein, 469 aa, Artificial Sequence; identical to SEQ ID NO: 16738
  neuraminidase__InfluenzaA__ADD25233

SEQ ID NO: 18192 - protein, 469 aa, Artificial Sequence; identical to SEQ ID NO: 16738
  neuraminidase__InfluenzaA__ADD25235

SEQ ID NO: 18193 - protein, 469 aa, Artificial Sequence; identical to SEQ ID NO: 16738
  neuraminidase__InfluenzaA__ADD25244

SEQ ID NO: 18194 - protein, 469 aa, Artificial Sequence
  neuraminidase__InfluenzaA__ADD25246
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGTNWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18195 - protein, 469 aa, Artificial Sequence; identical to SEQ ID NO: 16738
  neuraminidase__InfluenzaA__ADD25248

SEQ ID NO: 18196 - protein, 469 aa, Artificial Sequence
  neuraminidase__InfluenzaA__ADD25250
MNPNQKIITIGSVCMTIGMANLILQIGNIISIWISRSIQLGNQNQIETCNQSIITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSGEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTMGWSWPDGAELPFTIDK

SEQ ID NO: 18197 - protein, 469 aa, Artificial Sequence; identical to SEQ ID NO: 16738
  neuraminidase__InfluenzaA__ADD25255

SEQ ID NO: 18198 - protein, 469 aa, Artificial Sequence; identical to SEQ ID NO: 16738
  neuraminidase__InfluenzaA__ADD25259

SEQ ID NO: 18199 - protein, 469 aa, Artificial Sequence
  neuraminidase__InfluenzaA__ADD25262
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGADGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18200 - protein, 469 aa, Artificial Sequence
  neuraminidase__InfluenzaA__ADD25266
MNPNQKIITIGSVCMTIGMANLILQIGNIISIWISHSIQLGNQNQIETCNQSVITYENNTWVNQTYVNISNTNFAAGQSVVPVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18201 - protein, 469 aa, Artificial Sequence; identical to SEQ ID NO: 16738
  neuraminidase__InfluenzaA__ADD25268

SEQ ID NO: 18202 - protein, 469 aa, Artificial Sequence; identical to SEQ ID NO: 16738
  neuraminidase__InfluenzaA__ADD25271

SEQ ID NO: 18203 - protein, 469 aa, Artificial Sequence; identical to SEQ ID NO: 16738
  neuraminidase__InfluenzaA__ADD25274

SEQ ID NO: 18204 - protein, 469 aa, Artificial Sequence; identical to SEQ ID NO: 16738
  neuraminidase__InfluenzaA__ADD25276

SEQ ID NO: 18205 - protein, 469 aa, Artificial Sequence
  neuraminidase__InfluenzaA__ADD25278
MNPNQKIITIGSVCMTIGMANLILQIGNIISIWISRSIQLGNQNQIETCNQSIITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSGEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18206 - protein, 469 aa, Artificial Sequence; identical to SEQ ID NO: 16738
  neuraminidase__InfluenzaA__ADD25280

SEQ ID NO: 18207 - protein, 469 aa, Artificial Sequence; identical to SEQ ID NO: 16738
  neuraminidase__InfluenzaA__ADD25282

SEQ ID NO: 18208 - protein, 469 aa, Artificial Sequence; identical to SEQ ID NO: 18026
  neuraminidase__InfluenzaA__ADD25284

SEQ ID NO: 18209 - protein, 469 aa, Artificial Sequence; identical to SEQ ID NO: 16738
  neuraminidase__InfluenzaA__ADD25287

SEQ ID NO: 18210 - protein, 469 aa, Artificial Sequence; identical to SEQ ID NO: 16738
  neuraminidase__InfluenzaA__ADD25291

SEQ ID NO: 18211 - protein, 469 aa, Artificial Sequence; identical to SEQ ID NO: 18026
  neuraminidase__InfluenzaA__ADD25293

SEQ ID NO: 18212 - protein, 469 aa, Artificial Sequence; identical to SEQ ID NO: 16738
  neuraminidase__InfluenzaA__ADD25300

SEQ ID NO: 18213 - protein, 469 aa, Artificial Sequence
  neuraminidase__InfluenzaA__ADD25304
MNPNQKIITIGSVCMTIGMANLILQIGNIVSIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18214 - protein, 469 aa, Artificial Sequence
  neuraminidase__InfluenzaA__ADD25306
MNPNQKIITIGSVCMTIGMANLILQIGNIISIWISRSIQLGNQNQIETCNQSIITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDEPSDGQASYKIFRIEKGKIVKSVEMNAPNYHYEECSCYPDSGEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18215 - protein, 469 aa, Artificial Sequence; identical to SEQ ID NO: 16738
  neuraminidase__InfluenzaA__ADD25308

SEQ ID NO: 18216 - protein, 469 aa, Artificial Sequence; identical to SEQ ID NO: 16738
  neuraminidase__InfluenzaA__ADD25310

SEQ ID NO: 18217 - protein, 469 aa, Artificial Sequence; identical to SEQ ID NO: 16738
  neuraminidase__InfluenzaA__ADD25312

SEQ ID NO: 18218 - protein, 469 aa, Artificial Sequence; identical to SEQ ID NO: 16738
  neuraminidase__InfluenzaA__ADD25314

SEQ ID NO: 18219 - protein, 469 aa, Artificial Sequence; identical to SEQ ID NO: 16738
  neuraminidase__InfluenzaA__ADD25316

SEQ ID NO: 18220 - protein, 469 aa, Artificial Sequence; identical to SEQ ID NO: 16738
  neuraminidase__InfluenzaA__ADD29799

SEQ ID NO: 18221 - protein, 469 aa, Artificial Sequence; identical to SEQ ID NO: 16738
  neuraminidase__InfluenzaA__ADD29800

SEQ ID NO: 18222 - protein, 469 aa, Artificial Sequence; identical to SEQ ID NO: 16738
  neuraminidase__InfluenzaA__ADD29801

SEQ ID NO: 18223 - protein, 469 aa, Artificial Sequence; identical to SEQ ID NO: 16738
  neuraminidase__InfluenzaA__ADD29802

SEQ ID NO: 18224 - protein, 469 aa, Artificial Sequence; identical to SEQ ID NO: 16738
  neuraminidase__InfluenzaA__ADD29803

SEQ ID NO: 18225 - protein, 469 aa, Artificial Sequence; identical to SEQ ID NO: 16738
  neuraminidase__InfluenzaA__ADD29804

SEQ ID NO: 18226 - protein, 469 aa, Artificial Sequence; identical to SEQ ID NO: 16738
  neuraminidase__InfluenzaA__ADD29805

SEQ ID NO: 18227 - protein, 469 aa, Artificial Sequence; identical to SEQ ID NO: 16738
  neuraminidase__InfluenzaA__ADD29806

SEQ ID NO: 18228 - protein, 469 aa, Artificial Sequence; identical to SEQ ID NO: 16738
  neuraminidase__InfluenzaA__ADD29807

SEQ ID NO: 18229 - protein, 469 aa, Artificial Sequence; identical to SEQ ID NO: 16738
  neuraminidase__InfluenzaA__ADD29808

SEQ ID NO: 18230 - protein, 469 aa, Artificial Sequence; identical to SEQ ID NO: 16738
  neuraminidase__InfluenzaA__ADD52538

SEQ ID NO: 18231 - protein, 469 aa, Artificial Sequence; identical to SEQ ID NO: 17961
  neuraminidase__InfluenzaA__ADD74353

SEQ ID NO: 18232 - protein, 469 aa, Artificial Sequence; identical to SEQ ID NO: 16738
  neuraminidase__InfluenzaA__ADD74373

SEQ ID NO: 18233 - protein, 469 aa, Artificial Sequence; identical to SEQ ID NO: 16738
  neuraminidase__InfluenzaA__ADD74383

SEQ ID NO: 18234 - protein, 469 aa, Artificial Sequence; identical to SEQ ID NO: 16738
  neuraminidase__InfluenzaA__ADD74401

SEQ ID NO: 18235 - protein, 469 aa, Artificial Sequence
  neuraminidase__InfluenzaA__ADD74411
MNPNQKIITIGSVCMTIGMANLILQIGNIISIWISHSIQLGNQNQIETCNQSVITYENNTWVNQTYVNISNTNVAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGSGVWIGRTKSISSRSGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18236 - protein, 469 aa, Artificial Sequence; identical to SEQ ID NO: 16738
  neuraminidase__InfluenzaA__ADD74421

SEQ ID NO: 18237 - protein, 469 aa, Artificial Sequence; identical to SEQ ID NO: 16738
  neuraminidase__InfluenzaA__ADD74431

SEQ ID NO: 18238 - protein, 469 aa, Artificial Sequence
  neuraminidase__InfluenzaA__ADD74441
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNIFSIKQDIVGINEWSGYSGSFVQHPELTGLDCIRPCFWVELIRGRPKENTIWTSGSSISFCGVNSDTVGWSWPDGAELPFTIDK

SEQ ID NO: 18239 - protein, 469 aa, Artificial Sequence; identical to SEQ ID NO: 16738
  neuraminidase__InfluenzaA__ADD74451

SEQ ID NO: 18240 - protein, 469 aa, Artificial Sequence; identical to SEQ ID NO: 16738
  neuraminidase__InfluenzaA__ADD74461

SEQ ID NO: 18241 - protein, 469 aa, Artificial Sequence; identical to SEQ ID NO: 16738
  neuraminidase__InfluenzaA__ADD74471

SEQ ID NO: 18242 - protein, 469 aa, Artificial Sequence; identical to SEQ ID NO: 16738
  neuraminidase__InfluenzaA__ADD74481

SEQ ID NO: 18243 - protein, 469 aa, Artificial Sequence; identical to SEQ ID NO: 17755
  neuraminidase__InfluenzaA__ADD74491

SEQ ID NO: 18244 - protein, 469 aa, Artificial Sequence; identical to SEQ ID NO: 16738
  neuraminidase__InfluenzaA__ADD74501

SEQ ID NO: 18245 - protein, 469 aa, Artificial Sequence; identical to SEQ ID NO: 16738
  neuraminidase__InfluenzaA__ADD74511

SEQ ID NO: 18246 - protein, 469 aa, Artificial Sequence; identical to SEQ ID NO: 17756
  neuraminidase__InfluenzaA__ADD74521

SEQ ID NO: 18247 - protein, 469 aa, Artificial Sequence; identical to SEQ ID NO: 16738
  neuraminidase__InfluenzaA__ADD74531

SEQ ID NO: 18248 - protein, 469 aa, Artificial Sequence
  neuraminidase__InfluenzaA__ADD74551
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDYGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18249 - protein, 469 aa, Artificial Sequence; identical to SEQ ID NO: 16738
  neuraminidase__InfluenzaA__ADD74561

SEQ ID NO: 18250 - protein, 469 aa, Artificial Sequence; identical to SEQ ID NO: 16738
  neuraminidase__InfluenzaA__ADD74571

SEQ ID NO: 18251 - protein, 469 aa, Artificial Sequence
  neuraminidase__InfluenzaA__ADD74581
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDAVGWSWPDGAELPFTIDK

SEQ ID NO: 18252 - protein, 469 aa, Artificial Sequence; identical to SEQ ID NO: 16738
  neuraminidase__InfluenzaA__ADD74591

SEQ ID NO: 18253 - protein, 469 aa, Artificial Sequence; identical to SEQ ID NO: 16738
  neuraminidase__InfluenzaA__ADD74601

SEQ ID NO: 18254 - protein, 469 aa, Artificial Sequence
  neuraminidase__InfluenzaA__ADD74611
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGIKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18255 - protein, 469 aa, Artificial Sequence; identical to SEQ ID NO: 16738
  neuraminidase__InfluenzaA__ADD74621

SEQ ID NO: 18256 - protein, 469 aa, Artificial Sequence; identical to SEQ ID NO: 16738
  neuraminidase__InfluenzaA__ADD74631

SEQ ID NO: 18257 - protein, 469 aa, Artificial Sequence; identical to SEQ ID NO: 16738
  neuraminidase__InfluenzaA__ADD74641

SEQ ID NO: 18258 - protein, 469 aa, Artificial Sequence; identical to SEQ ID NO: 16738
  neuraminidase__InfluenzaA__ADD74651

SEQ ID NO: 18259 - protein, 469 aa, Artificial Sequence; identical to SEQ ID NO: 18089
  neuraminidase__InfluenzaA__ADD74661

SEQ ID NO: 18260 - protein, 469 aa, Artificial Sequence; identical to SEQ ID NO: 16738
  neuraminidase__InfluenzaA__ADD74671

SEQ ID NO: 18261 - protein, 469 aa, Artificial Sequence; identical to SEQ ID NO: 16738
  neuraminidase__InfluenzaA__ADD74681

SEQ ID NO: 18262 - protein, 469 aa, Artificial Sequence
  neuraminidase__InfluenzaA__ADD74691
MNPNQKIITIGSVCMTIGMANLILQIGNIISIWICHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18263 - protein, 469 aa, Artificial Sequence; identical to SEQ ID NO: 16738
  neuraminidase__InfluenzaA__ADD74701

SEQ ID NO: 18264 - protein, 469 aa, Artificial Sequence; identical to SEQ ID NO: 16738
  neuraminidase__InfluenzaA__ADD74711

SEQ ID NO: 18265 - protein, 469 aa, Artificial Sequence; identical to SEQ ID NO: 16738
  neuraminidase__InfluenzaA__ADD74721

SEQ ID NO: 18266 - protein, 469 aa, Artificial Sequence; identical to SEQ ID NO: 16738
  neuraminidase__InfluenzaA__ADD74731

SEQ ID NO: 18267 - protein, 469 aa, Artificial Sequence
  neuraminidase__InfluenzaA__ADD74741
MNPNQKIITIGSVCITIGMANLILQIGNIISIWISHSIQLGNQNQIETCNQSVITYENNTWVNQTYVNISNTNFAAGQSVVSVKLAGSSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18268 - protein, 469 aa, Artificial Sequence
  neuraminidase__InfluenzaA__ADD74751
MNPNQKIITIGSVCMTIGMANLILQIGNIISIWISHSIQLGNKNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLKYQIGYICSGIFGDNPRPNDKKGSCGPVSSNGANGVKGFSFKYGNGVWIGRTKSISSRNGFEMIWDPNGWTGTDNNFSIKQDIVGMNEWSGYSGSFVQHPELTGLDCIRPCFWVELIRGRPKENTIWTSGSSISFCGVNSDTVGWSWPDGAELPFTIDK

SEQ ID NO: 18269 - protein, 469 aa, Artificial Sequence
  neuraminidase__InfluenzaA__ADD74761
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGINSDTVGWSWPDGAELPFTIDK

SEQ ID NO: 18270 - protein, 469 aa, Artificial Sequence; identical to SEQ ID NO: 16738
  neuraminidase__InfluenzaA__ADD74791

SEQ ID NO: 18271 - protein, 469 aa, Artificial Sequence; identical to SEQ ID NO: 17321
  neuraminidase__InfluenzaA__ADD74811

SEQ ID NO: 18272 - protein, 469 aa, Artificial Sequence; identical to SEQ ID NO: 16738
  neuraminidase__InfluenzaA__ADD74821

SEQ ID NO: 18273 - protein, 469 aa, Artificial Sequence
  neuraminidase__InfluenzaA__ADD74831
MNPNQKIITIGSICMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACLNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18274 - protein, 469 aa, Artificial Sequence; identical to SEQ ID NO: 16738
  neuraminidase__InfluenzaA__ADD74841

SEQ ID NO: 18275 - protein, 469 aa, Artificial Sequence; identical to SEQ ID NO: 16738
  neuraminidase__InfluenzaA__ADD74851

SEQ ID NO: 18276 - protein, 469 aa, Artificial Sequence; identical to SEQ ID NO: 17845
  neuraminidase__InfluenzaA__ADD74861

SEQ ID NO: 18277 - protein, 469 aa, Artificial Sequence; identical to SEQ ID NO: 16738
  neuraminidase__InfluenzaA__ADD74871

SEQ ID NO: 18278 - protein, 469 aa, Artificial Sequence; identical to SEQ ID NO: 16738
  neuraminidase__InfluenzaA__ADD74881

SEQ ID NO: 18279 - protein, 469 aa, Artificial Sequence; identical to SEQ ID NO: 16738
  neuraminidase__InfluenzaA__ADD74891

SEQ ID NO: 18280 - protein, 469 aa, Artificial Sequence; identical to SEQ ID NO: 16738
  neuraminidase__InfluenzaA__ADD74901

SEQ ID NO: 18281 - protein, 469 aa, Artificial Sequence; identical to SEQ ID NO: 16738
  neuraminidase__InfluenzaA__ADD74911

SEQ ID NO: 18282 - protein, 469 aa, Artificial Sequence; identical to SEQ ID NO: 16738
  neuraminidase__InfluenzaA__ADD74921

SEQ ID NO: 18283 - protein, 469 aa, Artificial Sequence; identical to SEQ ID NO: 16738
  neuraminidase__InfluenzaA__ADD74941

SEQ ID NO: 18284 - protein, 469 aa, Artificial Sequence
  neuraminidase__InfluenzaA__ADD74961
MNPNQKIITIGSVCMTIGMANLILQIGNIISIWISHSIQLGNQNQIGTCNQSVITYENNTWVNHTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18285 - protein, 469 aa, Artificial Sequence; identical to SEQ ID NO: 16738
  neuraminidase__InfluenzaA__ADD74971

SEQ ID NO: 18286 - protein, 469 aa, Artificial Sequence
  neuraminidase__InfluenzaA__ADD74981
MNPNQKIITIGSVCMTIGMANLILQIGNIISIWISHSIQLGNQNQIETCNQSIITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRSGFEMIWDPNGWTGTDNNFSIKQDIVGINEWSGYSGSFVQHPELTGLDCIRPCFWVELIRGRPEENTIWTSGSSISFCGVNSDTVGWSWPDGAELPFTIDK

SEQ ID NO: 18287 - protein, 469 aa, Artificial Sequence; identical to SEQ ID NO: 16738
  neuraminidase__InfluenzaA__ADD74991

SEQ ID NO: 18288 - protein, 469 aa, Artificial Sequence; identical to SEQ ID NO: 16738
  neuraminidase__InfluenzaA__ADD75001

SEQ ID NO: 18289 - protein, 469 aa, Artificial Sequence
  neuraminidase__InfluenzaA__ADD75011
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCDPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18290 - protein, 469 aa, Artificial Sequence; identical to SEQ ID NO: 18026
  neuraminidase__InfluenzaA__ADD75031

SEQ ID NO: 18291 - protein, 469 aa, Artificial Sequence
  neuraminidase__InfluenzaA__ADD75041
MNPNQKIITIGSVCMTIGMANLILQIGNIISIWISHSIQLGNQNQIETCNQSVITYENKTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18292 - protein, 469 aa, Artificial Sequence; identical to SEQ ID NO: 16738
  neuraminidase__InfluenzaA__ADD75051

SEQ ID NO: 18293 - protein, 469 aa, Artificial Sequence; identical to SEQ ID NO: 16738
  neuraminidase__InfluenzaA__ADD75061

SEQ ID NO: 18294 - protein, 469 aa, Artificial Sequence; identical to SEQ ID NO: 16738
  neuraminidase__InfluenzaA__ADD75071

SEQ ID NO: 18295 - protein, 469 aa, Artificial Sequence; identical to SEQ ID NO: 16738
  neuraminidase__InfluenzaA__ADD75081

SEQ ID NO: 18296 - protein, 469 aa, Artificial Sequence
  neuraminidase__InfluenzaA__ADD75091
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRSGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18297 - protein, 469 aa, Artificial Sequence; identical to SEQ ID NO: 16738
  neuraminidase__InfluenzaA__ADD75101

SEQ ID NO: 18298 - protein, 469 aa, Artificial Sequence; identical to SEQ ID NO: 16738
  neuraminidase__InfluenzaA__ADD75111

SEQ ID NO: 18299 - protein, 469 aa, Artificial Sequence; identical to SEQ ID NO: 16738
  neuraminidase__InfluenzaA__ADD75121

SEQ ID NO: 18300 - protein, 469 aa, Artificial Sequence; identical to SEQ ID NO: 16738
  neuraminidase__InfluenzaA__ADD75131

SEQ ID NO: 18301 - protein, 469 aa, Artificial Sequence; identical to SEQ ID NO: 16738
  neuraminidase__InfluenzaA__ADD75141

SEQ ID NO: 18302 - protein, 469 aa, Artificial Sequence
  neuraminidase__InfluenzaA__ADD75161
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSSYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYKIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDR

SEQ ID NO: 18303 - protein, 469 aa, Artificial Sequence
  neuraminidase__InfluenzaA__ADD84500
MNPNQNIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFIVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18304 - protein, 469 aa, Artificial Sequence
  neuraminidase__InfluenzaA__ADD84502
MNPNQNIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18305 - protein, 469 aa, Artificial Sequence; identical to SEQ ID NO: 18304
  neuraminidase__InfluenzaA__ADD84503

SEQ ID NO: 18306 - protein, 469 aa, Artificial Sequence
  neuraminidase__InfluenzaA__ADD84504
MNPNQNIITIGSVCMTIGMANLILQIGNIISIWISHSIQLGNQNQIETCNQSVITYENNTWVNQTYVNISNTNFAAGQSVVSVKLAGNFSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18307 - protein, 469 aa, Artificial Sequence; identical to SEQ ID NO: 18304
  neuraminidase__InfluenzaA__ADD84505

SEQ ID NO: 18308 - protein, 469 aa, Artificial Sequence; identical to SEQ ID NO: 18304
  neuraminidase__InfluenzaA__ADD84506

SEQ ID NO: 18309 - protein, 469 aa, Artificial Sequence
  neuraminidase__InfluenzaA__ADD92528
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGHSGSSVQHPELTGLDCIRPCFWVELIRGRPKENTIWTSGSSISFCGVNSDTVGWSWPDGAELPFTIDK

SEQ ID NO: 18310 - protein, 469 aa, Artificial Sequence; identical to SEQ ID NO: 17961
  neuraminidase__InfluenzaA__ADD96769

SEQ ID NO: 18311 - protein, 469 aa, Artificial Sequence; identical to SEQ ID NO: 17961
  neuraminidase__InfluenzaA__ADD96779

SEQ ID NO: 18312 - protein, 469 aa, Artificial Sequence; identical to SEQ ID NO: 17961
  neuraminidase__InfluenzaA__ADD96789

SEQ ID NO: 18313 - protein, 469 aa, Artificial Sequence; identical to SEQ ID NO: 18089
  neuraminidase__InfluenzaA__ADD96799

SEQ ID NO: 18314 - protein, 469 aa, Artificial Sequence; identical to SEQ ID NO: 16738
  neuraminidase__InfluenzaA__ADD96809

SEQ ID NO: 18315 - protein, 469 aa, Artificial Sequence
  neuraminidase__InfluenzaA__ADD96819
MNPNQKIITIGSVCMTIGMANLILQIGNIISIWISHSIQLGNQNQIETCNQSVITYENNTWVNQTYVNISNTNFAAGQSVVSVKLAGSSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18316 - protein, 469 aa, Artificial Sequence; identical to SEQ ID NO: 16738
  neuraminidase__InfluenzaA__ADD96829

SEQ ID NO: 18317 - protein, 469 aa, Artificial Sequence; identical to SEQ ID NO: 16738
  neuraminidase__InfluenzaA__ADD96839

SEQ ID NO: 18318 - protein, 469 aa, Artificial Sequence; identical to SEQ ID NO: 16738
  neuraminidase__InfluenzaA__ADD96849

SEQ ID NO: 18319 - protein, 469 aa, Artificial Sequence; identical to SEQ ID NO: 16738
  neuraminidase__InfluenzaA__ADD96859

SEQ ID NO: 18320 - protein, 469 aa, Artificial Sequence
  neuraminidase__InfluenzaA__ADD96869
MNPNQKIITIGSVCMTIGMANLILQIGNIISIWISHPIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWKNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18321 - protein, 469 aa, Artificial Sequence
  neuraminidase__InfluenzaA__ADD96879
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLGCRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18322 - protein, 469 aa, Artificial Sequence; identical to SEQ ID NO: 16738
  neuraminidase__InfluenzaA__ADD96889

SEQ ID NO: 18323 - protein, 469 aa, Artificial Sequence; identical to SEQ ID NO: 17321
  neuraminidase__InfluenzaA__ADD96899

SEQ ID NO: 18324 - protein, 469 aa, Artificial Sequence; identical to SEQ ID NO: 16738
  neuraminidase__InfluenzaA__ADD96909

SEQ ID NO: 18325 - protein, 469 aa, Artificial Sequence; identical to SEQ ID NO: 16738
  neuraminidase__InfluenzaA__ADD96919

SEQ ID NO: 18326 - protein, 469 aa, Artificial Sequence; identical to SEQ ID NO: 16738
  neuraminidase__InfluenzaA__ADD96929

SEQ ID NO: 18327 - protein, 469 aa, Artificial Sequence; identical to SEQ ID NO: 16738
  neuraminidase__InfluenzaA__ADD96939

SEQ ID NO: 18328 - protein, 469 aa, Artificial Sequence; identical to SEQ ID NO: 16738
  neuraminidase__InfluenzaA__ADD96959

SEQ ID NO: 18329 - protein, 469 aa, Artificial Sequence; identical to SEQ ID NO: 16738
  neuraminidase__InfluenzaA__ADD96969

SEQ ID NO: 18330 - protein, 469 aa, Artificial Sequence
  neuraminidase__InfluenzaA__ADD96989
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSSYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18331 - protein, 469 aa, Artificial Sequence
  neuraminidase__InfluenzaA__ADD97038
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWIGTDNNFSIKQDIVGINEWSGYSGSFVQHPELTGLDCIRPCFWVELIRGRPKENTIWTSGSSISFCGVNSDTGGWSWPDGAELPFTIDK

SEQ ID NO: 18332 - protein, 469 aa, Artificial Sequence; identical to SEQ ID NO: 16738
  neuraminidase__InfluenzaA__ADD97048

SEQ ID NO: 18333 - protein, 469 aa, Artificial Sequence; identical to SEQ ID NO: 16738
  neuraminidase__InfluenzaA__ADD97058

SEQ ID NO: 18334 - protein, 469 aa, Artificial Sequence; identical to SEQ ID NO: 16738
  neuraminidase__InfluenzaA__ADD97069

SEQ ID NO: 18335 - protein, 469 aa, Artificial Sequence; identical to SEQ ID NO: 16738
  neuraminidase__InfluenzaA__ADD97126

SEQ ID NO: 18336 - protein, 469 aa, Artificial Sequence; identical to SEQ ID NO: 16738
  neuraminidase__InfluenzaA__ADD97164

SEQ ID NO: 18337 - protein, 469 aa, Artificial Sequence; identical to SEQ ID NO: 16738
  neuraminidase__InfluenzaA__ADD97174

SEQ ID NO: 18338 - protein, 469 aa, Artificial Sequence; identical to SEQ ID NO: 16738
  neuraminidase__InfluenzaA__ADD97184

SEQ ID NO: 18339 - protein, 469 aa, Artificial Sequence
  neuraminidase__InfluenzaA__ADD97194
MNPNQKIITIGSVCMTIGMANLILQIGNIISIWISHSIQLGNQNQIETCNQSVITYENNTWVNQTYVNISNANFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18340 - protein, 469 aa, Artificial Sequence; identical to SEQ ID NO: 18330
  neuraminidase__InfluenzaA__ADD97204

SEQ ID NO: 18341 - protein, 469 aa, Artificial Sequence; identical to SEQ ID NO: 16738
  neuraminidase__InfluenzaA__ADD97214

SEQ ID NO: 18342 - protein, 469 aa, Artificial Sequence; identical to SEQ ID NO: 16738
  neuraminidase__InfluenzaA__ADD97224

SEQ ID NO: 18343 - protein, 469 aa, Artificial Sequence; identical to SEQ ID NO: 16738
  neuraminidase__InfluenzaA__ADD97234

SEQ ID NO: 18344 - protein, 469 aa, Artificial Sequence; identical to SEQ ID NO: 16738
  neuraminidase__InfluenzaA__ADD97244

SEQ ID NO: 18345 - protein, 469 aa, Artificial Sequence; identical to SEQ ID NO: 16738
  neuraminidase__InfluenzaA__ADD97254

SEQ ID NO: 18346 - protein, 469 aa, Artificial Sequence; identical to SEQ ID NO: 16738
  neuraminidase__InfluenzaA__ADD97264

SEQ ID NO: 18347 - protein, 469 aa, Artificial Sequence; identical to SEQ ID NO: 16738
  neuraminidase__InfluenzaA__ADD97274

SEQ ID NO: 18348 - protein, 469 aa, Artificial Sequence
  neuraminidase__InfluenzaA__ADD97284
MNPNQKIITIGSVCMTIGMANLILQIGNIISIWISHSIQLGNQNQIETCNQSVITYENNTWVNQTYVNICNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18349 - protein, 469 aa, Artificial Sequence; identical to SEQ ID NO: 16738
  neuraminidase__InfluenzaA__ADD97294

SEQ ID NO: 18350 - protein, 469 aa, Artificial Sequence
  neuraminidase__InfluenzaA__ADD97314
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGTNEWSGYSGSFVQHPELTGLDCIRPCFWVELIRGRPKENTIWTSGSSISFCGVNSDTVGWSWPDGAELPFTIDK

SEQ ID NO: 18351 - protein, 469 aa, Artificial Sequence; identical to SEQ ID NO: 16738
  neuraminidase__InfluenzaA__ADD97334

SEQ ID NO: 18352 - protein, 469 aa, Artificial Sequence; identical to SEQ ID NO: 16738
  neuraminidase__InfluenzaA__ADD97344

SEQ ID NO: 18353 - protein, 469 aa, Artificial Sequence; identical to SEQ ID NO: 16738
  neuraminidase__InfluenzaA__ADD97354

SEQ ID NO: 18354 - protein, 469 aa, Artificial Sequence
  neuraminidase__InfluenzaA__ADD97384
MNPNQKIITIGSVCMTIGMANLILQIGNIISIWISHTIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18355 - protein, 469 aa, Artificial Sequence
  neuraminidase__InfluenzaA__ADD97394
MNPNQKIITIGSVCMTIGMANLILQIGNIISIWISHSIQLGNQNQIETCNQSVITYENNTWVNQTYVNISNTNFAAGQPVVSVKLAGNSSLCPVNGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18356 - protein, 469 aa, Artificial Sequence; identical to SEQ ID NO: 16738
  neuraminidase__InfluenzaA__ADD97404

SEQ ID NO: 18357 - protein, 469 aa, Artificial Sequence; identical to SEQ ID NO: 16738
  neuraminidase__InfluenzaA__ADD97424

SEQ ID NO: 18358 - protein, 469 aa, Artificial Sequence; identical to SEQ ID NO: 16738
  neuraminidase__InfluenzaA__ADD97434

SEQ ID NO: 18359 - protein, 469 aa, Artificial Sequence; identical to SEQ ID NO: 16738
  neuraminidase__InfluenzaA__ADD97444

SEQ ID NO: 18360 - protein, 469 aa, Artificial Sequence
  neuraminidase__InfluenzaA__ADD97454
MNPNQKIITIGSVCMTIGMANLILQIGNIISIWISHSIQLGNQNQIETCNQSVITYENNTWVNQTYVNISNTNFAAGQSVVSVKLAGNSSLCPISGWAIYSKDNSIRIGSKGDVFVIREPFISCSPLECRTFFLTQGALLSDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18361 - protein, 469 aa, Artificial Sequence
  neuraminidase__InfluenzaA__ADD97464
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSTKQDIVGINEWSGYSGSFVQHPELTGLDCIRPCFWVELIRGRPKENTIWTSGSSISFCGVNSDTVGWSWPDGAELPFTIDK

SEQ ID NO: 18362 - protein, 469 aa, Artificial Sequence; identical to SEQ ID NO: 16738
  neuraminidase__InfluenzaA__ADD97474

SEQ ID NO: 18363 - protein, 469 aa, Artificial Sequence; identical to SEQ ID NO: 16738
  neuraminidase__InfluenzaA__ADD97484

SEQ ID NO: 18364 - protein, 469 aa, Artificial Sequence
  neuraminidase__InfluenzaA__ADD97494
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPSECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18365 - protein, 469 aa, Artificial Sequence; identical to SEQ ID NO: 16738
  neuraminidase__InfluenzaA__ADD97504

SEQ ID NO: 18366 - protein, 469 aa, Artificial Sequence; identical to SEQ ID NO: 16738
  neuraminidase__InfluenzaA__ADD97514

SEQ ID NO: 18367 - protein, 469 aa, Artificial Sequence; identical to SEQ ID NO: 18350
  neuraminidase__InfluenzaA__ADD97534

SEQ ID NO: 18368 - protein, 469 aa, Artificial Sequence; identical to SEQ ID NO: 16738
  neuraminidase__InfluenzaA__ADD97544

SEQ ID NO: 18369 - protein, 469 aa, Artificial Sequence; identical to SEQ ID NO: 16738
  neuraminidase__InfluenzaA__ADD97554

SEQ ID NO: 18370 - protein, 469 aa, Artificial Sequence; identical to SEQ ID NO: 18354
  neuraminidase__InfluenzaA__ADD97564

SEQ ID NO: 18371 - protein, 469 aa, Artificial Sequence; identical to SEQ ID NO: 16738
  neuraminidase__InfluenzaA__ADD97574

SEQ ID NO: 18372 - protein, 469 aa, Artificial Sequence; identical to SEQ ID NO: 16738
  neuraminidase__InfluenzaA__ADD97584

SEQ ID NO: 18373 - protein, 469 aa, Artificial Sequence
  neuraminidase__InfluenzaA__ADD97681
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEINAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGINSDTVGWSWPDGAELPFTIDK

SEQ ID NO: 18374 - protein, 469 aa, Artificial Sequence; identical to SEQ ID NO: 18330
  neuraminidase__InfluenzaA__ADD97691

SEQ ID NO: 18375 - protein, 469 aa, Artificial Sequence; identical to SEQ ID NO: 17875
  neuraminidase__InfluenzaA__ADD97701

SEQ ID NO: 18376 - protein, 469 aa, Artificial Sequence; identical to SEQ ID NO: 16738
  neuraminidase__InfluenzaA__ADD97891

SEQ ID NO: 18377 - protein, 469 aa, Artificial Sequence; identical to SEQ ID NO: 16738
  neuraminidase__InfluenzaA__ADD97901

SEQ ID NO: 18378 - protein, 469 aa, Artificial Sequence; identical to SEQ ID NO: 16738
  neuraminidase__InfluenzaA__ADD97911

SEQ ID NO: 18379 - protein, 469 aa, Artificial Sequence; identical to SEQ ID NO: 16738
  neuraminidase__InfluenzaA__ADD97921

SEQ ID NO: 18380 - protein, 469 aa, Artificial Sequence; identical to SEQ ID NO: 16738
  neuraminidase__InfluenzaA__ADD97931

SEQ ID NO: 18381 - protein, 469 aa, Artificial Sequence; identical to SEQ ID NO: 17505
  neuraminidase__InfluenzaA__ADD97941

SEQ ID NO: 18382 - protein, 469 aa, Artificial Sequence
  neuraminidase__InfluenzaA__ADD97951
MNPNQKIITISSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18383 - protein, 469 aa, Artificial Sequence
  neuraminidase__InfluenzaA__ADD97961
MNPNQKIITIGSVCMTIGMVNLILQIGNIISIWISHSIQLGNQNQIETCNQSVITYENNTWVNQTYVNISNTNFAAGQSVVSVKLAGNASLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18384 - protein, 469 aa, Artificial Sequence; identical to SEQ ID NO: 18330
  neuraminidase__InfluenzaA__ADD97971

SEQ ID NO: 18385 - protein, 469 aa, Artificial Sequence; identical to SEQ ID NO: 16738
  neuraminidase__InfluenzaA__ADD97981

SEQ ID NO: 18386 - protein, 469 aa, Artificial Sequence
  neuraminidase__InfluenzaA__ADD97991
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWIGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18387 - protein, 469 aa, Artificial Sequence
  neuraminidase__InfluenzaA__ADD98001
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTVKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18388 - protein, 469 aa, Artificial Sequence; identical to SEQ ID NO: 16738
  neuraminidase__InfluenzaA__ADD98011

SEQ ID NO: 18389 - protein, 469 aa, Artificial Sequence; identical to SEQ ID NO: 16738
  neuraminidase__InfluenzaA__ADD98031

SEQ ID NO: 18390 - protein, 469 aa, Artificial Sequence; identical to SEQ ID NO: 18387
  neuraminidase__InfluenzaA__ADD98041

SEQ ID NO: 18391 - protein, 469 aa, Artificial Sequence; identical to SEQ ID NO: 16738
  neuraminidase__InfluenzaA__ADD98051

SEQ ID NO: 18392 - protein, 469 aa, Artificial Sequence; identical to SEQ ID NO: 16738
  neuraminidase__InfluenzaA__ADD98061

SEQ ID NO: 18393 - protein, 469 aa, Artificial Sequence; identical to SEQ ID NO: 16738
  neuraminidase__InfluenzaA__ADD98071

SEQ ID NO: 18394 - protein, 469 aa, Artificial Sequence; identical to SEQ ID NO: 16738
  neuraminidase__InfluenzaA__ADD98081

SEQ ID NO: 18395 - protein, 469 aa, Artificial Sequence; identical to SEQ ID NO: 16738
  neuraminidase__InfluenzaA__ADD98091

SEQ ID NO: 18396 - protein, 469 aa, Artificial Sequence; identical to SEQ ID NO: 17564
  neuraminidase__InfluenzaA__ADD98101

SEQ ID NO: 18397 - protein, 469 aa, Artificial Sequence
  neuraminidase__InfluenzaA__ADD98111
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGILGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18398 - protein, 469 aa, Artificial Sequence; identical to SEQ ID NO: 16738
  neuraminidase__InfluenzaA__ADD98121

SEQ ID NO: 18399 - protein, 469 aa, Artificial Sequence; identical to SEQ ID NO: 16738
  neuraminidase__InfluenzaA__ADD98131

SEQ ID NO: 18400 - protein, 469 aa, Artificial Sequence; identical to SEQ ID NO: 16738
  neuraminidase__InfluenzaA__ADD98141

SEQ ID NO: 18401 - protein, 469 aa, Artificial Sequence; identical to SEQ ID NO: 16738
  neuraminidase__InfluenzaA__ADD98151

SEQ ID NO: 18402 - protein, 469 aa, Artificial Sequence
  neuraminidase__InfluenzaA__ADD98161
MNPNQKIITIGSVCMTIGMANLILQIGNIISIWISHTIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTRTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18403 - protein, 469 aa, Artificial Sequence
  neuraminidase__InfluenzaA__ADD98171
MNPNQKIIIIGSVCMTIGMANLILQIGNIISIWISHSIQLGNQNQIETCNQSVITYENNTWVNQTYVNISNTNFAAGQTVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRSNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18404 - protein, 469 aa, Artificial Sequence
  neuraminidase__InfluenzaA__ADD98181
MNPNQKIITIGSVCMTIGMANLILQIGNMISIWISHSIQLENQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18405 - protein, 469 aa, Artificial Sequence; identical to SEQ ID NO: 16738
  neuraminidase__InfluenzaA__ADD98201

SEQ ID NO: 18406 - protein, 469 aa, Artificial Sequence; identical to SEQ ID NO: 16738
  neuraminidase__InfluenzaA__ADD98211

SEQ ID NO: 18407 - protein, 469 aa, Artificial Sequence; identical to SEQ ID NO: 17961
  neuraminidase__InfluenzaA__ADE20324

SEQ ID NO: 18408 - protein, 469 aa, Artificial Sequence; identical to SEQ ID NO: 17961
  neuraminidase__InfluenzaA__ADE20334

SEQ ID NO: 18409 - protein, 469 aa, Artificial Sequence; identical to SEQ ID NO: 17961
  neuraminidase__InfluenzaA__ADE20344

SEQ ID NO: 18410 - protein, 469 aa, Artificial Sequence; identical to SEQ ID NO: 17961
  neuraminidase__InfluenzaA__ADE20354

SEQ ID NO: 18411 - protein, 469 aa, Artificial Sequence; identical to SEQ ID NO: 17961
  neuraminidase__InfluenzaA__ADE20378

SEQ ID NO: 18412 - protein, 469 aa, Artificial Sequence; identical to SEQ ID NO: 17961
  neuraminidase__InfluenzaA__ADE20391

SEQ ID NO: 18413 - protein, 469 aa, Artificial Sequence; identical to SEQ ID NO: 17961
  neuraminidase__InfluenzaA__ADE20631

SEQ ID NO: 18414 - protein, 469 aa, Artificial Sequence; identical to SEQ ID NO: 17961
  neuraminidase__InfluenzaA__ADE20641

SEQ ID NO: 18415 - protein, 469 aa, Artificial Sequence
  neuraminidase__InfluenzaA__ADE20651
MNPNQKIITIGSVCMTIGMANLILQIGNIISIWISHSIQLGNQNQIETCNQSVITYENNTWVNQTYVNISNTNFAAGQSVVSVKLVGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18416 - protein, 469 aa, Artificial Sequence; identical to SEQ ID NO: 17961
  neuraminidase__InfluenzaA__ADE20661

SEQ ID NO: 18417 - protein, 469 aa, Artificial Sequence; identical to SEQ ID NO: 17961
  neuraminidase__InfluenzaA__ADE20671

SEQ ID NO: 18418 - protein, 469 aa, Artificial Sequence; identical to SEQ ID NO: 17961
  neuraminidase__InfluenzaA__ADE20681

SEQ ID NO: 18419 - protein, 469 aa, Artificial Sequence
  neuraminidase__InfluenzaA__ADE20701
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGVITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18420 - protein, 469 aa, Artificial Sequence; identical to SEQ ID NO: 17961
  neuraminidase__InfluenzaA__ADE20711

SEQ ID NO: 18421 - protein, 469 aa, Artificial Sequence
  neuraminidase__InfluenzaA__ADE20721
MNPNQKIITIGSVCMTIGMANLILQIGNIISIWISHSIQLGNQNQIETCNQSVITYENNTWVNQTYVNISNTNFAAGQSVVSVKLVGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDR

SEQ ID NO: 18422 - protein, 469 aa, Artificial Sequence; identical to SEQ ID NO: 18419
  neuraminidase__InfluenzaA__ADE20731

SEQ ID NO: 18423 - protein, 469 aa, Artificial Sequence; identical to SEQ ID NO: 17961
  neuraminidase__InfluenzaA__ADE20741

SEQ ID NO: 18424 - protein, 469 aa, Artificial Sequence; identical to SEQ ID NO: 17961
  neuraminidase__InfluenzaA__ADE20751

SEQ ID NO: 18425 - protein, 469 aa, Artificial Sequence; identical to SEQ ID NO: 18419
  neuraminidase__InfluenzaA__ADE20761

SEQ ID NO: 18426 - protein, 469 aa, Artificial Sequence; identical to SEQ ID NO: 18419
  neuraminidase__InfluenzaA__ADE20781

SEQ ID NO: 18427 - protein, 469 aa, Artificial Sequence; identical to SEQ ID NO: 16738
  neuraminidase__InfluenzaA__ADE20791

SEQ ID NO: 18428 - protein, 469 aa, Artificial Sequence; identical to SEQ ID NO: 16738
  neuraminidase__InfluenzaA__ADE20801

SEQ ID NO: 18429 - protein, 469 aa, Artificial Sequence; identical to SEQ ID NO: 16738
  neuraminidase__InfluenzaA__ADE20811

SEQ ID NO: 18430 - protein, 469 aa, Artificial Sequence; identical to SEQ ID NO: 16738
  neuraminidase__InfluenzaA__ADE20821

SEQ ID NO: 18431 - protein, 469 aa, Artificial Sequence; identical to SEQ ID NO: 16738
  neuraminidase__InfluenzaA__ADE20831

SEQ ID NO: 18432 - protein, 469 aa, Artificial Sequence; identical to SEQ ID NO: 16738
  neuraminidase__InfluenzaA__ADE20841

SEQ ID NO: 18433 - protein, 469 aa, Artificial Sequence; identical to SEQ ID NO: 16738
  neuraminidase__InfluenzaA__ADE20851

SEQ ID NO: 18434 - protein, 469 aa, Artificial Sequence; identical to SEQ ID NO: 18354
  neuraminidase__InfluenzaA__ADE20861

SEQ ID NO: 18435 - protein, 469 aa, Artificial Sequence; identical to SEQ ID NO: 16738
  neuraminidase__InfluenzaA__ADE20871

SEQ ID NO: 18436 - protein, 469 aa, Artificial Sequence; identical to SEQ ID NO: 18350
  neuraminidase__InfluenzaA__ADE20881

SEQ ID NO: 18437 - protein, 469 aa, Artificial Sequence; identical to SEQ ID NO: 16738
  neuraminidase__InfluenzaA__ADE20891

SEQ ID NO: 18438 - protein, 469 aa, Artificial Sequence; identical to SEQ ID NO: 16738
  neuraminidase__InfluenzaA__ADE20901

SEQ ID NO: 18439 - protein, 469 aa, Artificial Sequence; identical to SEQ ID NO: 16738
  neuraminidase__InfluenzaA__ADE20911

SEQ ID NO: 18440 - protein, 469 aa, Artificial Sequence; identical to SEQ ID NO: 16738
  neuraminidase__InfluenzaA__ADE20921

SEQ ID NO: 18441 - protein, 469 aa, Artificial Sequence
  neuraminidase__InfluenzaA__ADE20931
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVLSNGANGVKGFSFKYGNGVWIGRTKSIGSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18442 - protein, 469 aa, Artificial Sequence; identical to SEQ ID NO: 16738
  neuraminidase__InfluenzaA__ADE20941

SEQ ID NO: 18443 - protein, 469 aa, Artificial Sequence
  neuraminidase__InfluenzaA__ADE20951
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDVVGINEWSGYSGSFVQHPELTGLDCIRPCFWVELIRGRPKENTIWTSGSSISFCGVNSDTVGWSWPDGAELPFTIDK

SEQ ID NO: 18444 - protein, 469 aa, Artificial Sequence
  neuraminidase__InfluenzaA__ADE20961
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNDIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18445 - protein, 469 aa, Artificial Sequence; identical to SEQ ID NO: 16738
  neuraminidase__InfluenzaA__ADE20971

SEQ ID NO: 18446 - protein, 469 aa, Artificial Sequence; identical to SEQ ID NO: 18354
  neuraminidase__InfluenzaA__ADE20981

SEQ ID NO: 18447 - protein, 469 aa, Artificial Sequence; identical to SEQ ID NO: 16738
  neuraminidase__InfluenzaA__ADE20991

SEQ ID NO: 18448 - protein, 469 aa, Artificial Sequence
  neuraminidase__InfluenzaA__ADE21001
MNPNQKIITIGSVCMTIGMANLILQIGNIISIWISHTIQLGNQNQIETCNQSVITYENNTWVNQTYVNISNTNFAAGQSVVSVKLAGNSSLCPVSGWAIYSKDNSIRIGSKGDVFIIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18449 - protein, 469 aa, Artificial Sequence; identical to SEQ ID NO: 16738
  neuraminidase__InfluenzaA__ADE21011

SEQ ID NO: 18450 - protein, 469 aa, Artificial Sequence; identical to SEQ ID NO: 16738
  neuraminidase__InfluenzaA__ADE21021

SEQ ID NO: 18451 - protein, 469 aa, Artificial Sequence; identical to SEQ ID NO: 18387
  neuraminidase__InfluenzaA__ADE21031

SEQ ID NO: 18452 - protein, 469 aa, Artificial Sequence
  neuraminidase__InfluenzaA__ADE21041
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSIEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18453 - protein, 469 aa, Artificial Sequence; identical to SEQ ID NO: 16738
  neuraminidase__InfluenzaA__ADE21051

SEQ ID NO: 18454 - protein, 469 aa, Artificial Sequence
  neuraminidase__InfluenzaA__ADE21071
MNPNQKIITIGSVCMTIGMANLILQIGNIISIWISHSIQLGNQNQIETCNQSVITYENNTWVNQTYVNISNTNFAAGQSVVSVKLAGNSSLCPVNGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 18455 - protein, 470 aa, Artificial Sequence; identical to SEQ ID NO: 16632
  neuraminidase__InfluenzaA__ADE28752

SEQ ID NO: 18456 - protein, 470 aa, Artificial Sequence; identical to SEQ ID NO: 17461
  neuraminidase__InfluenzaA__ADE28763

SEQ ID NO: 18457 - protein, 469 aa, Artificial Sequence; identical to SEQ ID NO: 17961
  neuraminidase__InfluenzaA__ADE28773

SEQ ID NO: 18458 - protein, 469 aa, Artificial Sequence; identical to SEQ ID NO: 17961
  neuraminidase__InfluenzaA__ADE28783

SEQ ID NO: 18459 - protein, 469 aa, Artificial Sequence; identical to SEQ ID NO: 18419
  neuraminidase__InfluenzaA__ADE28803

SEQ ID NO: 18460 - protein, 469 aa, Artificial Sequence; identical to SEQ ID NO: 16738
  neuraminidase__InfluenzaA__ADE28813

SEQ ID NO: 18461 - protein, 469 aa, Artificial Sequence; identical to SEQ ID NO: 16738
  neuraminidase__InfluenzaA__ADE28823

SEQ ID NO: 18462 - protein, 469 aa, Artificial Sequence
  neuraminidase__InfluenzaA__ADE28843
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPVGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18463 - protein, 469 aa, Artificial Sequence
  neuraminidase__InfluenzaA__ADE28853
MNPNQKIITIVSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18464 - protein, 469 aa, Artificial Sequence; identical to SEQ ID NO: 18462
  neuraminidase__InfluenzaA__ADE28884

SEQ ID NO: 18465 - protein, 469 aa, Artificial Sequence
  neuraminidase__InfluenzaA__ADE28894
MNPNQKIITIGSVCMTIGMANLILQIGNIISIWISHSVQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18466 - protein, 469 aa, Artificial Sequence; identical to SEQ ID NO: 18386
  neuraminidase__InfluenzaA__ADE28904

SEQ ID NO: 18467 - protein, 469 aa, Artificial Sequence; identical to SEQ ID NO: 16738
  neuraminidase__InfluenzaA__ADE28914

SEQ ID NO: 18468 - protein, 469 aa, Artificial Sequence; identical to SEQ ID NO: 16738
  neuraminidase__InfluenzaA__ADE28924

SEQ ID NO: 18469 - protein, 469 aa, Artificial Sequence
  neuraminidase__InfluenzaA__ADE28934
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACINGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18470 - protein, 469 aa, Artificial Sequence; identical to SEQ ID NO: 16738
  neuraminidase__InfluenzaA__ADE28954

SEQ ID NO: 18471 - protein, 469 aa, Artificial Sequence
  neuraminidase__InfluenzaA__ADE28964
MNPNQKIITIGSVCMTIGMANLILQIGNIISIWISHSIQLGNQNQIETCNQSVITYENNTWVNQTYVNISNINFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18472 - protein, 469 aa, Artificial Sequence; identical to SEQ ID NO: 16738
  neuraminidase__InfluenzaA__ADE28974

SEQ ID NO: 18473 - protein, 469 aa, Artificial Sequence
  neuraminidase__InfluenzaA__ADE29004
MNPNQKIITIGSVCMTIGLANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDKNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18474 - protein, 469 aa, Artificial Sequence; identical to SEQ ID NO: 16738
  neuraminidase__InfluenzaA__ADE29014

SEQ ID NO: 18475 - protein, 469 aa, Artificial Sequence
  neuraminidase__InfluenzaA__ADE29024
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWKNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWNGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18476 - protein, 469 aa, Artificial Sequence; identical to SEQ ID NO: 16738
  neuraminidase__InfluenzaA__ADE29034

SEQ ID NO: 18477 - protein, 469 aa, Artificial Sequence; identical to SEQ ID NO: 16738
  neuraminidase__InfluenzaA__ADE29044

SEQ ID NO: 18478 - protein, 469 aa, Artificial Sequence; identical to SEQ ID NO: 16738
  neuraminidase__InfluenzaA__ADE29054

SEQ ID NO: 18479 - protein, 469 aa, Artificial Sequence; identical to SEQ ID NO: 18026
  neuraminidase__InfluenzaA__ADE29064

SEQ ID NO: 18480 - protein, 469 aa, Artificial Sequence
  neuraminidase__InfluenzaA__ADE29087
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECKTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18481 - protein, 469 aa, Artificial Sequence; identical to SEQ ID NO: 16728
  neuraminidase__InfluenzaA__ADE29097

SEQ ID NO: 18482 - protein, 469 aa, Artificial Sequence; identical to SEQ ID NO: 17605
  neuraminidase__InfluenzaA__ADE34194

SEQ ID NO: 18483 - protein, 469 aa, Artificial Sequence; identical to SEQ ID NO: 16599
  neuraminidase__InfluenzaA__ADE34205

SEQ ID NO: 18484 - protein, 469 aa, Artificial Sequence
  neuraminidase__InfluenzaA__ADE34216
MNPNQKIITIGSVSLTISTICFFMQIAILVTTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 18485 - protein, 469 aa, Artificial Sequence; identical to SEQ ID NO: 17605
  neuraminidase__InfluenzaA__ADE34227

SEQ ID NO: 18486 - protein, 469 aa, Artificial Sequence; identical to SEQ ID NO: 17605
  neuraminidase__InfluenzaA__ADE34238

SEQ ID NO: 18487 - protein, 469 aa, Artificial Sequence
  neuraminidase__InfluenzaA__ADE34260
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMSI

SEQ ID NO: 18488 - protein, 469 aa, Artificial Sequence; identical to SEQ ID NO: 17605
  neuraminidase__InfluenzaA__ADE34271

SEQ ID NO: 18489 - protein, 469 aa, Artificial Sequence; identical to SEQ ID NO: 16738
  neuraminidase__InfluenzaA__ADE45502

SEQ ID NO: 18490 - protein, 469 aa, Artificial Sequence; identical to SEQ ID NO: 16738
  neuraminidase__InfluenzaA__ADE45504

SEQ ID NO: 18491 - protein, 469 aa, Artificial Sequence; identical to SEQ ID NO: 16738
  neuraminidase__InfluenzaA__ADE45506

SEQ ID NO: 18492 - protein, 469 aa, Artificial Sequence; identical to SEQ ID NO: 16738
  neuraminidase__InfluenzaA__ADE45508

SEQ ID NO: 18493 - protein, 469 aa, Artificial Sequence; identical to SEQ ID NO: 16738
  neuraminidase__InfluenzaA__ADE45510

SEQ ID NO: 18494 - protein, 469 aa, Artificial Sequence; identical to SEQ ID NO: 16738
  neuraminidase__InfluenzaA__ADE45512

SEQ ID NO: 18495 - protein, 469 aa, Artificial Sequence
  neuraminidase__InfluenzaA__ADE45514
MNPNQKIITIGSVCMTIGMANLILQIGNIISIWISHSIQLGNQNQIETCNQSIITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFQYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18496 - protein, 469 aa, Artificial Sequence
  neuraminidase__InfluenzaA__ADE45516
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISLRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18497 - protein, 469 aa, Artificial Sequence
  neuraminidase__InfluenzaA__ADF10069
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGTLLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18498 - protein, 469 aa, Artificial Sequence; identical to SEQ ID NO: 16738
  neuraminidase__InfluenzaA__ADF10079

SEQ ID NO: 18499 - protein, 469 aa, Artificial Sequence; identical to SEQ ID NO: 16738
  neuraminidase__InfluenzaA__ADF10089

SEQ ID NO: 18500 - protein, 469 aa, Artificial Sequence; identical to SEQ ID NO: 16738
  neuraminidase__InfluenzaA__ADF10099

SEQ ID NO: 18501 - protein, 469 aa, Artificial Sequence
  neuraminidase__InfluenzaA__ADF10109
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVSFNQNLEYQIGYICSGIFGDNPRPNDKTGNCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18502 - protein, 469 aa, Artificial Sequence; identical to SEQ ID NO: 16738
  neuraminidase__InfluenzaA__ADF10129

SEQ ID NO: 18503 - protein, 469 aa, Artificial Sequence; identical to SEQ ID NO: 18168
  neuraminidase__InfluenzaA__ADF10146

SEQ ID NO: 18504 - protein, 469 aa, Artificial Sequence
  neuraminidase__InfluenzaA__ADF10166
MNPNQKIITIGSVCMIIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18505 - protein, 469 aa, Artificial Sequence; identical to SEQ ID NO: 18504
  neuraminidase__InfluenzaA__ADF10176

SEQ ID NO: 18506 - protein, 469 aa, Artificial Sequence; identical to SEQ ID NO: 18504
  neuraminidase__InfluenzaA__ADF10192

SEQ ID NO: 18507 - protein, 469 aa, Artificial Sequence; identical to SEQ ID NO: 16738
  neuraminidase__InfluenzaA__ADF10247

SEQ ID NO: 18508 - protein, 469 aa, Artificial Sequence; identical to SEQ ID NO: 18504
  neuraminidase__InfluenzaA__ADF10290

SEQ ID NO: 18509 - protein, 469 aa, Artificial Sequence
  neuraminidase__InfluenzaA__ADF10304
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAGLPFTIDK

SEQ ID NO: 18510 - protein, 469 aa, Artificial Sequence; identical to SEQ ID NO: 16738
  neuraminidase__InfluenzaA__ADF10340

SEQ ID NO: 18511 - protein, 469 aa, Artificial Sequence; identical to SEQ ID NO: 16738
  neuraminidase__InfluenzaA__ADF10361

SEQ ID NO: 18512 - protein, 469 aa, Artificial Sequence; identical to SEQ ID NO: 18504
  neuraminidase__InfluenzaA__ADF10371

SEQ ID NO: 18513 - protein, 469 aa, Artificial Sequence; identical to SEQ ID NO: 18504
  neuraminidase__InfluenzaA__ADF10407

SEQ ID NO: 18514 - protein, 469 aa, Artificial Sequence; identical to SEQ ID NO: 16738
  neuraminidase__InfluenzaA__ADF10472

SEQ ID NO: 18515 - protein, 469 aa, Artificial Sequence; identical to SEQ ID NO: 18504
  neuraminidase__InfluenzaA__ADF10616

SEQ ID NO: 18516 - protein, 469 aa, Artificial Sequence; identical to SEQ ID NO: 18504
  neuraminidase__InfluenzaA__ADF10688

SEQ ID NO: 18517 - protein, 469 aa, Artificial Sequence; identical to SEQ ID NO: 18504
  neuraminidase__InfluenzaA__ADF10726

SEQ ID NO: 18518 - protein, 469 aa, Artificial Sequence; identical to SEQ ID NO: 16738
  neuraminidase__InfluenzaA__ADF10773

SEQ ID NO: 18519 - protein, 469 aa, Artificial Sequence
  neuraminidase__InfluenzaA__ADF10837
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWKNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18520 - protein, 469 aa, Artificial Sequence; identical to SEQ ID NO: 16738
  neuraminidase__InfluenzaA__ADF10889

SEQ ID NO: 18521 - protein, 469 aa, Artificial Sequence; identical to SEQ ID NO: 16738
  neuraminidase__InfluenzaA__ADF10947

SEQ ID NO: 18522 - protein, 469 aa, Artificial Sequence; identical to SEQ ID NO: 16738
  neuraminidase__InfluenzaA__ADF11010

SEQ ID NO: 18523 - protein, 469 aa, Artificial Sequence
  neuraminidase__InfluenzaA__ADF27355
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWMGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18524 - protein, 469 aa, Artificial Sequence
  neuraminidase__InfluenzaA__ADF27356
MNPNQKIITIGSVCMTIGMANLILQIGNIISIWISHSIQLGNQNQIETCNQNVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18525 - protein, 469 aa, Artificial Sequence; identical to SEQ ID NO: 17092
  neuraminidase__InfluenzaA__ADF27357

SEQ ID NO: 18526 - protein, 469 aa, Artificial Sequence; identical to SEQ ID NO: 17092
  neuraminidase__InfluenzaA__ADF27358

SEQ ID NO: 18527 - protein, 469 aa, Artificial Sequence; identical to SEQ ID NO: 17092
  neuraminidase__InfluenzaA__ADF27360

SEQ ID NO: 18528 - protein, 469 aa, Artificial Sequence; identical to SEQ ID NO: 16738
  neuraminidase__InfluenzaA__ADF27361

SEQ ID NO: 18529 - protein, 469 aa, Artificial Sequence; identical to SEQ ID NO: 16738
  neuraminidase__InfluenzaA__ADF27362

SEQ ID NO: 18530 - protein, 469 aa, Artificial Sequence; identical to SEQ ID NO: 16738
  neuraminidase__InfluenzaA__ADF27363

SEQ ID NO: 18531 - protein, 469 aa, Artificial Sequence; identical to SEQ ID NO: 17092
  neuraminidase__InfluenzaA__ADF27364

SEQ ID NO: 18532 - protein, 469 aa, Artificial Sequence; identical to SEQ ID NO: 16738
  neuraminidase__InfluenzaA__ADF27365

SEQ ID NO: 18533 - protein, 469 aa, Artificial Sequence; identical to SEQ ID NO: 17092
  neuraminidase__InfluenzaA__ADF27366

SEQ ID NO: 18534 - protein, 469 aa, Artificial Sequence; identical to SEQ ID NO: 16738
  neuraminidase__InfluenzaA__ADF27382

SEQ ID NO: 18535 - protein, 469 aa, Artificial Sequence; identical to SEQ ID NO: 16738
  neuraminidase__InfluenzaA__ADF27392

SEQ ID NO: 18536 - protein, 469 aa, Artificial Sequence; identical to SEQ ID NO: 16738
  neuraminidase__InfluenzaA__ADF27402

SEQ ID NO: 18537 - protein, 469 aa, Artificial Sequence; identical to SEQ ID NO: 18519
  neuraminidase__InfluenzaA__ADF27422

SEQ ID NO: 18538 - protein, 469 aa, Artificial Sequence
  neuraminidase__InfluenzaA__ADF27432
MNPNQKIITIGSVCVTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18539 - protein, 469 aa, Artificial Sequence
  neuraminidase__InfluenzaA__ADF27442
MNPNQKIITIGSVCMTIGMANLILQIGNIISIWISHSIQLENQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18540 - protein, 469 aa, Artificial Sequence
  neuraminidase__InfluenzaA__ADF27462
MNPNQKIITIGSVCMTIGMANLILQIGNIISIWISHSIQLGNQNQIEACNQSVITYENNTWVNQTYVNISNTNFAAGQSVVSVKLAGNSSLCPVSGWAVYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18541 - protein, 469 aa, Artificial Sequence; identical to SEQ ID NO: 16738
  neuraminidase__InfluenzaA__ADF27472

SEQ ID NO: 18542 - protein, 469 aa, Artificial Sequence
  neuraminidase__InfluenzaA__ADF27482
MNPNQKIITIGSVCMTIGMANLILQIGNIISIWISHSIQLGNQNQVETCNQSIITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18543 - protein, 469 aa, Artificial Sequence
  neuraminidase__InfluenzaA__ADF27492
MNPNQKIITIGSVCMTIGMANLILQIGNIISIWISHSIQLGNQNQIEPCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSIEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTVWTSGSSISFCGVNSDTVGWSWPDGAELPFTIDK

SEQ ID NO: 18544 - protein, 469 aa, Artificial Sequence; identical to SEQ ID NO: 16738
  neuraminidase__InfluenzaA__ADF27502

SEQ ID NO: 18545 - protein, 469 aa, Artificial Sequence; identical to SEQ ID NO: 16738
  neuraminidase__InfluenzaA__ADF27512

SEQ ID NO: 18546 - protein, 469 aa, Artificial Sequence
  neuraminidase__InfluenzaA__ADF27522
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRIKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18547 - protein, 469 aa, Artificial Sequence; identical to SEQ ID NO: 16738
  neuraminidase__InfluenzaA__ADF27532

SEQ ID NO: 18548 - protein, 469 aa, Artificial Sequence
  neuraminidase__InfluenzaA__ADF27542
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18549 - protein, 469 aa, Artificial Sequence
  neuraminidase__InfluenzaA__ADF27552
MNPNQKIITIGSVCMTIGLANLILQIGNIISIWVSHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDKNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18550 - protein, 469 aa, Artificial Sequence; identical to SEQ ID NO: 17564
  neuraminidase__InfluenzaA__ADF27562

SEQ ID NO: 18551 - protein, 469 aa, Artificial Sequence; identical to SEQ ID NO: 16738
  neuraminidase__InfluenzaA__ADF27572

SEQ ID NO: 18552 - protein, 469 aa, Artificial Sequence
  neuraminidase__InfluenzaA__ADF27582
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18553 - protein, 469 aa, Artificial Sequence; identical to SEQ ID NO: 16738
  neuraminidase__InfluenzaA__ADF27592

SEQ ID NO: 18554 - protein, 469 aa, Artificial Sequence
  neuraminidase__InfluenzaA__ADF27602
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIERGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNSFSIKQDIVGINEWSGYSGSFVQHPELTGLDCIRPCFWVELIRGRPKENTIWTSGSSISFCGVNSDTVGWSWPDGAELPFTIDK

SEQ ID NO: 18555 - protein, 469 aa, Artificial Sequence; identical to SEQ ID NO: 16738
  neuraminidase__InfluenzaA__ADF27612

SEQ ID NO: 18556 - protein, 469 aa, Artificial Sequence; identical to SEQ ID NO: 18026
  neuraminidase__InfluenzaA__ADF27622

SEQ ID NO: 18557 - protein, 469 aa, Artificial Sequence; identical to SEQ ID NO: 18473
  neuraminidase__InfluenzaA__ADF27632

SEQ ID NO: 18558 - protein, 469 aa, Artificial Sequence; identical to SEQ ID NO: 16738
  neuraminidase__InfluenzaA__ADF27642

SEQ ID NO: 18559 - protein, 469 aa, Artificial Sequence; identical to SEQ ID NO: 16738
  neuraminidase__InfluenzaA__ADF27652

SEQ ID NO: 18560 - protein, 469 aa, Artificial Sequence
  neuraminidase__InfluenzaA__ADF27662
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACNDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18561 - protein, 469 aa, Artificial Sequence; identical to SEQ ID NO: 16738
  neuraminidase__InfluenzaA__ADF27672

SEQ ID NO: 18562 - protein, 469 aa, Artificial Sequence; identical to SEQ ID NO: 16738
  neuraminidase__InfluenzaA__ADF27682

SEQ ID NO: 18563 - protein, 469 aa, Artificial Sequence; identical to SEQ ID NO: 16738
  neuraminidase__InfluenzaA__ADF27692

SEQ ID NO: 18564 - protein, 469 aa, Artificial Sequence; identical to SEQ ID NO: 16738
  neuraminidase__InfluenzaA__ADF27702

SEQ ID NO: 18565 - protein, 469 aa, Artificial Sequence; identical to SEQ ID NO: 16738
  neuraminidase__InfluenzaA__ADF27712

SEQ ID NO: 18566 - protein, 469 aa, Artificial Sequence; identical to SEQ ID NO: 18026
  neuraminidase__InfluenzaA__ADF27788

SEQ ID NO: 18567 - protein, 469 aa, Artificial Sequence; identical to SEQ ID NO: 17981
  neuraminidase__InfluenzaA__ADF27798

SEQ ID NO: 18568 - protein, 469 aa, Artificial Sequence; identical to SEQ ID NO: 18473
  neuraminidase__InfluenzaA__ADF27808

SEQ ID NO: 18569 - protein, 469 aa, Artificial Sequence
  neuraminidase__InfluenzaA__ADF27818
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSINSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18570 - protein, 469 aa, Artificial Sequence; identical to SEQ ID NO: 16738
  neuraminidase__InfluenzaA__ADF27838

SEQ ID NO: 18571 - protein, 469 aa, Artificial Sequence; identical to SEQ ID NO: 16738
  neuraminidase__InfluenzaA__ADF27848

SEQ ID NO: 18572 - protein, 469 aa, Artificial Sequence
  neuraminidase__InfluenzaA__ADF27858
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSSSACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNGDTVGWSWPDGAELPFTIDK

SEQ ID NO: 18573 - protein, 469 aa, Artificial Sequence
  neuraminidase__InfluenzaA__ADF27878
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNGDTVGWSWPDGAELPFTIDK

SEQ ID NO: 18574 - protein, 469 aa, Artificial Sequence; identical to SEQ ID NO: 18026
  neuraminidase__InfluenzaA__ADF27888

SEQ ID NO: 18575 - protein, 469 aa, Artificial Sequence; identical to SEQ ID NO: 16738
  neuraminidase__InfluenzaA__ADF27898

SEQ ID NO: 18576 - protein, 469 aa, Artificial Sequence; identical to SEQ ID NO: 18026
  neuraminidase__InfluenzaA__ADF27908

SEQ ID NO: 18577 - protein, 469 aa, Artificial Sequence; identical to SEQ ID NO: 18026
  neuraminidase__InfluenzaA__ADF27918

SEQ ID NO: 18578 - protein, 469 aa, Artificial Sequence
  neuraminidase__InfluenzaA__ADF27938
MNPNQRIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSMSFCGVNSDTVGWSWPDGAELPFTIDK

SEQ ID NO: 18579 - protein, 469 aa, Artificial Sequence; identical to SEQ ID NO: 16738
  neuraminidase__InfluenzaA__ADF27948

SEQ ID NO: 18580 - protein, 469 aa, Artificial Sequence; identical to SEQ ID NO: 18026
  neuraminidase__InfluenzaA__ADF27958

SEQ ID NO: 18581 - protein, 469 aa, Artificial Sequence; identical to SEQ ID NO: 16738
  neuraminidase__InfluenzaA__ADF27968

SEQ ID NO: 18582 - protein, 469 aa, Artificial Sequence; identical to SEQ ID NO: 18026
  neuraminidase__InfluenzaA__ADF27978

SEQ ID NO: 18583 - protein, 469 aa, Artificial Sequence
  neuraminidase__InfluenzaA__ADF27988
MNPNQKIITIGSVCMTIGLANLILQIGNIISIWISHSIQLGNQNQIETCNQSVISYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDKNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18584 - protein, 469 aa, Artificial Sequence; identical to SEQ ID NO: 16738
  neuraminidase__InfluenzaA__ADF27998

SEQ ID NO: 18585 - protein, 469 aa, Artificial Sequence; identical to SEQ ID NO: 16738
  neuraminidase__InfluenzaA__ADF28008

SEQ ID NO: 18586 - protein, 469 aa, Artificial Sequence; identical to SEQ ID NO: 17625
  neuraminidase__InfluenzaA__ADF28018

SEQ ID NO: 18587 - protein, 469 aa, Artificial Sequence; identical to SEQ ID NO: 16738
  neuraminidase__InfluenzaA__ADF28028

SEQ ID NO: 18588 - protein, 469 aa, Artificial Sequence
  neuraminidase__InfluenzaA__ADF28038
MNPNQKIITIGSVCMTIGMANLILQIGNIISIWISHSIQLGNQNQIETCNQSVITYENNTWVNQTYVNISNTNFATGQLVVSVKLAGNSSLCPVSGWAIYSKDNSIRIGSKGDVFVIREPFISCSPLECRTFFLTQGALLNDRHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18589 - protein, 469 aa, Artificial Sequence; identical to SEQ ID NO: 16738
  neuraminidase__InfluenzaA__ADF28048

SEQ ID NO: 18590 - protein, 469 aa, Artificial Sequence; identical to SEQ ID NO: 16738
  neuraminidase__InfluenzaA__ADF28058

SEQ ID NO: 18591 - protein, 469 aa, Artificial Sequence
  neuraminidase__InfluenzaA__ADF28068
MNPNQKIITIGSVCMTIGMANLILQIGNIISIWISHSIQLGNQNQIETCNQSVITYENNTWVNQTYVNISNTNFAAGQSVVSVKLAGSSSLCPVSGWAIYSKDNSIRIGSKGDVFVIREPFISCSHLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18592 - protein, 469 aa, Artificial Sequence; identical to SEQ ID NO: 16738
  neuraminidase__InfluenzaA__ADF28078

SEQ ID NO: 18593 - protein, 469 aa, Artificial Sequence; identical to SEQ ID NO: 16738
  neuraminidase__InfluenzaA__ADF28088

SEQ ID NO: 18594 - protein, 469 aa, Artificial Sequence; identical to SEQ ID NO: 18200
  neuraminidase__InfluenzaA__ADF28110

SEQ ID NO: 18595 - protein, 469 aa, Artificial Sequence; identical to SEQ ID NO: 16738
  neuraminidase__InfluenzaA__ADF28120

SEQ ID NO: 18596 - protein, 469 aa, Artificial Sequence; identical to SEQ ID NO: 16738
  neuraminidase__InfluenzaA__ADF29919

SEQ ID NO: 18597 - protein, 469 aa, Artificial Sequence; identical to SEQ ID NO: 17875
  neuraminidase__InfluenzaA__ADF42692

SEQ ID NO: 18598 - protein, 469 aa, Artificial Sequence; identical to SEQ ID NO: 16738
  neuraminidase__InfluenzaA__ADF42702

SEQ ID NO: 18599 - protein, 469 aa, Artificial Sequence; identical to SEQ ID NO: 18573
  neuraminidase__InfluenzaA__ADF42712

SEQ ID NO: 18600 - protein, 469 aa, Artificial Sequence; identical to SEQ ID NO: 16738
  neuraminidase__InfluenzaA__ADF42722

SEQ ID NO: 18601 - protein, 469 aa, Artificial Sequence; identical to SEQ ID NO: 18026
  neuraminidase__InfluenzaA__ADF42732

SEQ ID NO: 18602 - protein, 469 aa, Artificial Sequence; identical to SEQ ID NO: 16738
  neuraminidase__InfluenzaA__ADF42742

SEQ ID NO: 18603 - protein, 469 aa, Artificial Sequence; identical to SEQ ID NO: 16728
  neuraminidase__InfluenzaA__ADF58339

SEQ ID NO: 18604 - protein, 469 aa, Artificial Sequence; identical to SEQ ID NO: 16738
  neuraminidase__InfluenzaA__ADF58348

SEQ ID NO: 18605 - protein, 469 aa, Artificial Sequence; identical to SEQ ID NO: 16738
  neuraminidase__InfluenzaA__ADF58350

SEQ ID NO: 18606 - protein, 469 aa, Artificial Sequence; identical to SEQ ID NO: 16738
  neuraminidase__InfluenzaA__ADF58352

SEQ ID NO: 18607 - protein, 469 aa, Artificial Sequence
  neuraminidase__InfluenzaA__ADF80459
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVTFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTVWTSGSSISFCGVNSDTVGWSWPDGAELPFTIDK

SEQ ID NO: 18608 - protein, 469 aa, Artificial Sequence
  neuraminidase__InfluenzaA__ADF80503
MNPNQKIITIGSVCMTIGMANLILQIGNITSIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18609 - protein, 469 aa, Artificial Sequence
  neuraminidase__InfluenzaA__ADF83744
MNPNQKIITIGSVSLTISTICFFMQIAILITTVTLHFKQYEFNSPPNNQVMLCEPTIIEKNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 18610 - protein, 469 aa, Artificial Sequence; identical to SEQ ID NO: 17592
  neuraminidase__InfluenzaA__ADF83755

SEQ ID NO: 18611 - protein, 469 aa, Artificial Sequence
  neuraminidase__InfluenzaA__ADF83766
MNPNQKIITIGSVCMTIGMANLILQIGNIISIWISHSIQLGNQNQTETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYDNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18612 - protein, 469 aa, Artificial Sequence; identical to SEQ ID NO: 16738
  neuraminidase__InfluenzaA__ADF83776

SEQ ID NO: 18613 - protein, 469 aa, Artificial Sequence
  neuraminidase__InfluenzaA__ADF83786
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNGDTVGWSWPDGAELPFTIDK

SEQ ID NO: 18614 - protein, 469 aa, Artificial Sequence
  neuraminidase__InfluenzaA__ADF83796
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVRINEWSGYSGSFVQHPELTGLDCIRPCFWVELIRGRPKENTIWTSGSSISFCGVNSDTVGWSWPDGAELPFTIDK

SEQ ID NO: 18615 - protein, 469 aa, Artificial Sequence; identical to SEQ ID NO: 16738
  neuraminidase__InfluenzaA__ADF83806

SEQ ID NO: 18616 - protein, 469 aa, Artificial Sequence; identical to SEQ ID NO: 18251
  neuraminidase__InfluenzaA__ADF83816

SEQ ID NO: 18617 - protein, 469 aa, Artificial Sequence; identical to SEQ ID NO: 16738
  neuraminidase__InfluenzaA__ADF83826

SEQ ID NO: 18618 - protein, 469 aa, Artificial Sequence; identical to SEQ ID NO: 16738
  neuraminidase__InfluenzaA__ADF83836

SEQ ID NO: 18619 - protein, 469 aa, Artificial Sequence; identical to SEQ ID NO: 16738
  neuraminidase__InfluenzaA__ADF83846

SEQ ID NO: 18620 - protein, 469 aa, Artificial Sequence; identical to SEQ ID NO: 16738
  neuraminidase__InfluenzaA__ADF83856

SEQ ID NO: 18621 - protein, 469 aa, Artificial Sequence; identical to SEQ ID NO: 18089
  neuraminidase__InfluenzaA__ADF83866

SEQ ID NO: 18622 - protein, 469 aa, Artificial Sequence; identical to SEQ ID NO: 18519
  neuraminidase__InfluenzaA__ADF83876

SEQ ID NO: 18623 - protein, 469 aa, Artificial Sequence; identical to SEQ ID NO: 18169
  neuraminidase__InfluenzaA__ADF83888

SEQ ID NO: 18624 - protein, 469 aa, Artificial Sequence
  neuraminidase__InfluenzaA__ADF83898
MNPNQKIITIGSVCMTIGMANLILQIGNIISIWISHPIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18625 - protein, 469 aa, Artificial Sequence; identical to SEQ ID NO: 16738
  neuraminidase__InfluenzaA__ADF83908

SEQ ID NO: 18626 - protein, 469 aa, Artificial Sequence; identical to SEQ ID NO: 16738
  neuraminidase__InfluenzaA__ADF83918

SEQ ID NO: 18627 - protein, 469 aa, Artificial Sequence; identical to SEQ ID NO: 16738
  neuraminidase__InfluenzaA__ADF84444

SEQ ID NO: 18628 - protein, 469 aa, Artificial Sequence; identical to SEQ ID NO: 16738
  neuraminidase__InfluenzaA__ADF84462

SEQ ID NO: 18629 - protein, 469 aa, Artificial Sequence
  neuraminidase__InfluenzaA__ADF84472
MNPNQKIITIGSVCMTIGMANLILQIGNIISIWISHSIQLGNQNQIETCNQSVITYENNTWVNQTYVNISNTNFAAEQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18630 - protein, 469 aa, Artificial Sequence
  neuraminidase__InfluenzaA__ADF84482
MNPNQKIIIIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFAIKQDIVGINEWSGYSGSFVQHPELTGLDCIRPCFWVELIRGRPKENTIWTSGSSISFCGVNSDTVSWSWPDGAELPFTIDK

SEQ ID NO: 18631 - protein, 469 aa, Artificial Sequence
  neuraminidase__InfluenzaA__ADF84492
MNPNQKIITIGSVCMTIGMANLILQIGNIISIWISHSIQLGNQDQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18632 - protein, 469 aa, Artificial Sequence; identical to SEQ ID NO: 17845
  neuraminidase__InfluenzaA__ADF85020

SEQ ID NO: 18633 - protein, 469 aa, Artificial Sequence; identical to SEQ ID NO: 16738
  neuraminidase__InfluenzaA__ADF87155

SEQ ID NO: 18634 - protein, 469 aa, Artificial Sequence
  neuraminidase__InfluenzaA__ADF87165
MNPNQKIIIIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIDKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFAIKQDIVGINEWSGYSGSFVQHPELTGLDCIRPCFWVELIRGRPKENTIWTSGSSISFCGVNSDTVGWSWPDGAELPFTIDK

SEQ ID NO: 18635 - protein, 469 aa, Artificial Sequence; identical to SEQ ID NO: 18629
  neuraminidase__InfluenzaA__ADF87175

SEQ ID NO: 18636 - protein, 469 aa, Artificial Sequence; identical to SEQ ID NO: 16738
  neuraminidase__InfluenzaA__ADF87185

SEQ ID NO: 18637 - protein, 469 aa, Artificial Sequence; identical to SEQ ID NO: 18629
  neuraminidase__InfluenzaA__ADF87195

SEQ ID NO: 18638 - protein, 469 aa, Artificial Sequence; identical to SEQ ID NO: 16738
  neuraminidase__InfluenzaA__ADF87205

SEQ ID NO: 18639 - protein, 469 aa, Artificial Sequence; identical to SEQ ID NO: 16738
  neuraminidase__InfluenzaA__ADF87215

SEQ ID NO: 18640 - protein, 469 aa, Artificial Sequence
  neuraminidase__InfluenzaA__ADF87235
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18641 - protein, 469 aa, Artificial Sequence; identical to SEQ ID NO: 18629
  neuraminidase__InfluenzaA__ADF87245

SEQ ID NO: 18642 - protein, 469 aa, Artificial Sequence; identical to SEQ ID NO: 18629
  neuraminidase__InfluenzaA__ADF87265

SEQ ID NO: 18643 - protein, 469 aa, Artificial Sequence
  neuraminidase__InfluenzaA__ADF87285
MNPNQKIITIGSVCMSIGMANLILQIGNIISIWISHSIQLGNKNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGMNEWSGYSGSFVQHPELTGLDCIRPCFWVELIRGRPKENTIWTSGSSISFCGVNSDTVGWSWPDGAELPFTIDK

SEQ ID NO: 18644 - protein, 469 aa, Artificial Sequence; identical to SEQ ID NO: 16738
  neuraminidase__InfluenzaA__ADF87295

SEQ ID NO: 18645 - protein, 469 aa, Artificial Sequence; identical to SEQ ID NO: 16738
  neuraminidase__InfluenzaA__ADF87305

SEQ ID NO: 18646 - protein, 469 aa, Artificial Sequence; identical to SEQ ID NO: 16738
  neuraminidase__InfluenzaA__ADF87334

SEQ ID NO: 18647 - protein, 469 aa, Artificial Sequence; identical to SEQ ID NO: 16738
  neuraminidase__InfluenzaA__ADF87344

SEQ ID NO: 18648 - protein, 469 aa, Artificial Sequence
  neuraminidase__InfluenzaA__ADF87354
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNYFSIKQDIVGINEWSGYSGSFVQHPELTGLDCIRPCFWVELIRGRPKENTIWTSGSSISFCGVNSDTVGWSWPDGAELPFTIDK

SEQ ID NO: 18649 - protein, 469 aa, Artificial Sequence; identical to SEQ ID NO: 17321
  neuraminidase__InfluenzaA__ADF87364

SEQ ID NO: 18650 - protein, 469 aa, Artificial Sequence; identical to SEQ ID NO: 16738
  neuraminidase__InfluenzaA__ADF87374

SEQ ID NO: 18651 - protein, 469 aa, Artificial Sequence
  neuraminidase__InfluenzaA__ADF87384
MNPNQKIITIGSVCMTIGMANLILQIGNIISIWISHSIQLGNQNQIETCNQSIITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18652 - protein, 469 aa, Artificial Sequence; identical to SEQ ID NO: 16738
  neuraminidase__InfluenzaA__ADF97251

SEQ ID NO: 18653 - protein, 469 aa, Artificial Sequence; identical to SEQ ID NO: 17981
  neuraminidase__InfluenzaA__ADF97252

SEQ ID NO: 18654 - protein, 469 aa, Artificial Sequence; identical to SEQ ID NO: 16738
  neuraminidase__InfluenzaA__ADF97253

SEQ ID NO: 18655 - protein, 469 aa, Artificial Sequence; identical to SEQ ID NO: 16738
  neuraminidase__InfluenzaA__ADF97254

SEQ ID NO: 18656 - protein, 469 aa, Artificial Sequence
  neuraminidase__InfluenzaA__ADF97255
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNHFSIKQDIVGINEWSGYSGSFVQHPELTGLDCIRPCFWVELIRGRPKENTIWTSGSSISFCGVNSDTVGWSWPDGAELPFTIDK

SEQ ID NO: 18657 - protein, 469 aa, Artificial Sequence; identical to SEQ ID NO: 16738
  neuraminidase__InfluenzaA__ADF97256

SEQ ID NO: 18658 - protein, 469 aa, Artificial Sequence; identical to SEQ ID NO: 16738
  neuraminidase__InfluenzaA__ADF97257

SEQ ID NO: 18659 - protein, 469 aa, Artificial Sequence; identical to SEQ ID NO: 17092
  neuraminidase__InfluenzaA__ADF97837

SEQ ID NO: 18660 - protein, 469 aa, Artificial Sequence; identical to SEQ ID NO: 16738
  neuraminidase__InfluenzaA__ADG08120

SEQ ID NO: 18661 - protein, 449 aa, Artificial Sequence
  neuraminidase__InfluenzaA__ADG21408
MNPNQKIITIGSICMVIGIVSLMLQIGNMISIWVSHSIQTGNQCQDEPISNTKFLTEKAVASVTLAGNLSLCPVSGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 18662 - protein, 449 aa, Artificial Sequence; identical to SEQ ID NO: 17023
  neuraminidase__InfluenzaA__ADG21409

SEQ ID NO: 18663 - protein, 449 aa, Artificial Sequence; identical to SEQ ID NO: 17023
  neuraminidase__InfluenzaA__ADG21415

SEQ ID NO: 18664 - protein, 449 aa, Artificial Sequence; identical to SEQ ID NO: 17023
  neuraminidase__InfluenzaA__ADG21417

SEQ ID NO: 18665 - protein, 449 aa, Artificial Sequence
  neuraminidase__InfluenzaA__ADG21419
MNPNQKIITIGSICMVIGIVSLMLQIGNMISIWVSHSIQTGNQCQDESISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 18666 - protein, 449 aa, Artificial Sequence
  neuraminidase__InfluenzaA__ADG21423
MNPNQKIITIGSICMVIGIVSLMLQIGNMISIWVSHSIQTGNQCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDSWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 18667 - protein, 449 aa, Artificial Sequence
  neuraminidase__InfluenzaA__ADG21424
MNPNQKIITIGSICMVIGIASLMLQIGNMISIWVSHSIQTGNQCQDESISNTKFLTEKAVASVTLAGNSSLCPISGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 18668 - protein, 449 aa, Artificial Sequence
  neuraminidase__InfluenzaA__ADG21426
MNPNQKIITIGSICMVIGIVSLMLQIGNMISIWVSHSIQTENQCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVRQDIVAITDWSGYSGSFVQHPELTGLDCIRPCFWVELIRGRPKESTIWTSGSSISFCGVNGDTVSWSWPDGAELPFTIDK

SEQ ID NO: 18669 - protein, 449 aa, Artificial Sequence
  neuraminidase__InfluenzaA__ADG21428
MNPNQKIITIGSICMVIGIVSLMLQIGNMISIWVSHPIQTGNQCQDKPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNSIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 18670 - protein, 449 aa, Artificial Sequence; identical to SEQ ID NO: 17023
  neuraminidase__InfluenzaA__ADG21430

SEQ ID NO: 18671 - protein, 449 aa, Artificial Sequence
  neuraminidase__InfluenzaA__ADG21432
MNPNQKIITIGSICMVIGIVSLMLQIGNMISIWVSHSIQTGNQCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFRYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 18672 - protein, 449 aa, Artificial Sequence
  neuraminidase__InfluenzaA__ADG21438
MNPNQKIITIGSICMVIGIVSLMLQIGNMISIWISHSIQTGNQCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGSGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 18673 - protein, 449 aa, Artificial Sequence
  neuraminidase__InfluenzaA__ADG21440
MNPNQKIITIGSICMVIGIASLMLQIGNMISIWVSHSIQTGNQCQDESISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWVSFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 18674 - protein, 449 aa, Artificial Sequence; identical to SEQ ID NO: 17023
  neuraminidase__InfluenzaA__ADG21442

SEQ ID NO: 18675 - protein, 449 aa, Artificial Sequence
  neuraminidase__InfluenzaA__ADG21444
MNPNQKIITIGSICMVIGIVSLMLQIGNMISIWVSHSIQTGNQCQDESISNTKFLTEKAVTSVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWISFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 18676 - protein, 449 aa, Artificial Sequence; identical to SEQ ID NO: 17023
  neuraminidase__InfluenzaA__ADG21446

SEQ ID NO: 18677 - protein, 449 aa, Artificial Sequence
  neuraminidase__InfluenzaA__ADG21448
MNPNQKIITIGSICMVIGIVSLMLQIGNMISIWVSHSIQTGNQCQDEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNIMRTQESECACVNGSCFTVMTDGPSSGQASYKIFKMEKGKVVKSVELDAPNYHYEECSCYPDAGEITCVCRDNWHGSNRPWISFNQNLEYQIGYICSGVFGDNPRPNDGTGSCGPVFPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNGDTVSWSWPDGAELPFTIDK

SEQ ID NO: 18678 - protein, 449 aa, Artificial Sequence; identical to SEQ ID NO: 18677
  neuraminidase__InfluenzaA__ADG21450

SEQ ID NO: 18679 - protein, 469 aa, Artificial Sequence; identical to SEQ ID NO: 16738
  neuraminidase__InfluenzaA__ADG27797

SEQ ID NO: 18680 - protein, 469 aa, Artificial Sequence
  neuraminidase__InfluenzaA__ADG27983
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNHHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTMGWSWPDGAELPFTIDK

SEQ ID NO: 18681 - protein, 469 aa, Artificial Sequence; identical to SEQ ID NO: 16738
  neuraminidase__InfluenzaA__ADG27989

SEQ ID NO: 18682 - protein, 469 aa, Artificial Sequence; identical to SEQ ID NO: 18680
  neuraminidase__InfluenzaA__ADG27998

SEQ ID NO: 18683 - protein, 469 aa, Artificial Sequence; identical to SEQ ID NO: 17092
  neuraminidase__InfluenzaA__ADG28013

SEQ ID NO: 18684 - protein, 469 aa, Artificial Sequence; identical to SEQ ID NO: 16738
  neuraminidase__InfluenzaA__ADG42086

SEQ ID NO: 18685 - protein, 469 aa, Artificial Sequence; identical to SEQ ID NO: 16738
  neuraminidase__InfluenzaA__ADG42096

SEQ ID NO: 18686 - protein, 469 aa, Artificial Sequence; identical to SEQ ID NO: 18315
  neuraminidase__InfluenzaA__ADG42106

SEQ ID NO: 18687 - protein, 469 aa, Artificial Sequence; identical to SEQ ID NO: 16738
  neuraminidase__InfluenzaA__ADG42116

SEQ ID NO: 18688 - protein, 469 aa, Artificial Sequence; identical to SEQ ID NO: 16738
  neuraminidase__InfluenzaA__ADG42126

SEQ ID NO: 18689 - protein, 469 aa, Artificial Sequence; identical to SEQ ID NO: 16738
  neuraminidase__InfluenzaA__ADG42136

SEQ ID NO: 18690 - protein, 469 aa, Artificial Sequence; identical to SEQ ID NO: 17321
  neuraminidase__InfluenzaA__ADG42146

SEQ ID NO: 18691 - protein, 469 aa, Artificial Sequence; identical to SEQ ID NO: 16738
  neuraminidase__InfluenzaA__ADG42156

SEQ ID NO: 18692 - protein, 469 aa, Artificial Sequence; identical to SEQ ID NO: 16738
  neuraminidase__InfluenzaA__ADG42166

SEQ ID NO: 18693 - protein, 469 aa, Artificial Sequence; identical to SEQ ID NO: 16738
  neuraminidase__InfluenzaA__ADG42186

SEQ ID NO: 18694 - protein, 469 aa, Artificial Sequence; identical to SEQ ID NO: 18629
  neuraminidase__InfluenzaA__ADG42196

SEQ ID NO: 18695 - protein, 469 aa, Artificial Sequence
  neuraminidase__InfluenzaA__ADG42206
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSKITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18696 - protein, 469 aa, Artificial Sequence; identical to SEQ ID NO: 16738
  neuraminidase__InfluenzaA__ADG42216

SEQ ID NO: 18697 - protein, 469 aa, Artificial Sequence; identical to SEQ ID NO: 18089
  neuraminidase__InfluenzaA__ADG42226

SEQ ID NO: 18698 - protein, 469 aa, Artificial Sequence; identical to SEQ ID NO: 16738
  neuraminidase__InfluenzaA__ADG42236

SEQ ID NO: 18699 - protein, 469 aa, Artificial Sequence; identical to SEQ ID NO: 16738
  neuraminidase__InfluenzaA__ADG42246

SEQ ID NO: 18700 - protein, 469 aa, Artificial Sequence; identical to SEQ ID NO: 16738
  neuraminidase__InfluenzaA__ADG42256

SEQ ID NO: 18701 - protein, 469 aa, Artificial Sequence; identical to SEQ ID NO: 16738
  neuraminidase__InfluenzaA__ADG42276

SEQ ID NO: 18702 - protein, 469 aa, Artificial Sequence
  neuraminidase__InfluenzaA__ADG42296
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRAQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18703 - protein, 469 aa, Artificial Sequence; identical to SEQ ID NO: 16738
  neuraminidase__InfluenzaA__ADG42306

SEQ ID NO: 18704 - protein, 469 aa, Artificial Sequence; identical to SEQ ID NO: 16738
  neuraminidase__InfluenzaA__ADG42316

SEQ ID NO: 18705 - protein, 469 aa, Artificial Sequence; identical to SEQ ID NO: 16738
  neuraminidase__InfluenzaA__ADG42326

SEQ ID NO: 18706 - protein, 469 aa, Artificial Sequence
  neuraminidase__InfluenzaA__ADG42336
MNPNQKIITIGSVCMTIGMANLILQIGNIISIWISHSIQLGNQNQIETCNQSVITYENNTWVNQTYVNISNTNFAAGQSVVSMKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 18707 - protein, 469 aa, Artificial Sequence; identical to SEQ ID NO: 18200
  neuraminidase__InfluenzaA__ADG42346

SEQ ID NO: 18708 - protein, 469 aa, Artificial Sequence; identical to SEQ ID NO: 17915
  neuraminidase__InfluenzaA__ADG42356

SEQ ID NO: 18709 - protein, 469 aa, Artificial Sequence
  neuraminidase__InfluenzaA__ADG42366
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWISFNQNLEYQIGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 18710 - protein, 469 aa, Artificial Sequence; identical to SEQ ID NO: 16738
  neuraminidase__InfluenzaA__ADG42376

SEQ ID NO: 18711 - protein, 469 aa, Artificial Sequence
  neuraminidase__InfluenzaA__ADG42386
MNPNQKIITIGSVCMTIGMANLILQIGNIISIWISHSIQLGNQNQIETCNQSVITYENNTWVNQTYVNISNTNFAAGQSVVSVKFAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPNDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRSGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 18712 - protein, 469 aa, Artificial Sequence; identical to SEQ ID NO: 18695
  neuraminidase__InfluenzaA__ADG42396

SEQ ID NO: 18713 - protein, 469 aa, Artificial Sequence
  neuraminidase__InfluenzaA__ADG42406
MNPNQKIITIGSVCMTIGMANLILQIGNILSTWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18714 - protein, 469 aa, Artificial Sequence; identical to SEQ ID NO: 17915
  neuraminidase__InfluenzaA__ADG42426

SEQ ID NO: 18715 - protein, 469 aa, Artificial Sequence; identical to SEQ ID NO: 16738
  neuraminidase__InfluenzaA__ADG42436

SEQ ID NO: 18716 - protein, 469 aa, Artificial Sequence
  neuraminidase__InfluenzaA__ADG42446
MNPNQKIITIGSVCMTIGMANLILQIGNIISIWISHSIQLGNQNQIETCNQSVITYENNTWVNQTYVNISNTNFAAGQSVVSAKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18717 - protein, 469 aa, Artificial Sequence
  neuraminidase__InfluenzaA__ADG42456
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPHRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18718 - protein, 469 aa, Artificial Sequence; identical to SEQ ID NO: 16738
  neuraminidase__InfluenzaA__ADG42466

SEQ ID NO: 18719 - protein, 469 aa, Artificial Sequence
  neuraminidase__InfluenzaA__ADG42476
MNPNQKIITIGSVCMTIGMANLILQIGNIISIWISHSIQLGNQNQTETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18720 - protein, 469 aa, Artificial Sequence; identical to SEQ ID NO: 18640
  neuraminidase__InfluenzaA__ADG42486

SEQ ID NO: 18721 - protein, 469 aa, Artificial Sequence; identical to SEQ ID NO: 16738
  neuraminidase__InfluenzaA__ADG42496

SEQ ID NO: 18722 - protein, 469 aa, Artificial Sequence
  neuraminidase__InfluenzaA__ADG42506
MNPNQKIIIIGSVCMTIGMANLILQIGNIISIWISHSIQLGNQNQIETCNQSIITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKVVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18723 - protein, 469 aa, Artificial Sequence; identical to SEQ ID NO: 17913
  neuraminidase__InfluenzaA__ADG42516

SEQ ID NO: 18724 - protein, 469 aa, Artificial Sequence
  neuraminidase__InfluenzaA__ADG42526
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACLNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18725 - protein, 469 aa, Artificial Sequence
  neuraminidase__InfluenzaA__ADG42536
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVTSDTVGWSWPDGAELPFTIDK

SEQ ID NO: 18726 - protein, 469 aa, Artificial Sequence; identical to SEQ ID NO: 16738
  neuraminidase__InfluenzaA__ADG42546

SEQ ID NO: 18727 - protein, 469 aa, Artificial Sequence; identical to SEQ ID NO: 16738
  neuraminidase__InfluenzaA__ADG42556

SEQ ID NO: 18728 - protein, 469 aa, Artificial Sequence
  neuraminidase__InfluenzaA__ADG42566
MNPNQKIITIGSVCMTIGMANLILQIGNIISIWISHSIQLGNQNQIETCNQSVITYENNTWVNQTYVNISNTNFAAGHSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18729 - protein, 469 aa, Artificial Sequence
  neuraminidase__InfluenzaA__ADG42576
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPYNGAVAVLKYNGIITDTIKSWRNNILRTQESECACVNGSCFTVMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18730 - protein, 469 aa, Artificial Sequence; identical to SEQ ID NO: 16738
  neuraminidase__InfluenzaA__ADG42586

SEQ ID NO: 18731 - protein, 469 aa, Artificial Sequence
  neuraminidase__InfluenzaA__ADG42606
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFPIDK

SEQ ID NO: 18732 - protein, 469 aa, Artificial Sequence
  neuraminidase__InfluenzaA__ADG42616
MNSNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18733 - protein, 469 aa, Artificial Sequence; identical to SEQ ID NO: 17321
  neuraminidase__InfluenzaA__ADG42626

SEQ ID NO: 18734 - protein, 469 aa, Artificial Sequence; identical to SEQ ID NO: 18719
  neuraminidase__InfluenzaA__ADG42636

SEQ ID NO: 18735 - protein, 469 aa, Artificial Sequence
  neuraminidase__InfluenzaA__ADG42646
MNPNQRIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18736 - protein, 469 aa, Artificial Sequence; identical to SEQ ID NO: 16738
  neuraminidase__InfluenzaA__ADG42656

SEQ ID NO: 18737 - protein, 469 aa, Artificial Sequence; identical to SEQ ID NO: 18651
  neuraminidase__InfluenzaA__ADG42666

SEQ ID NO: 18738 - protein, 469 aa, Artificial Sequence
  neuraminidase__InfluenzaA__ADG42676
MNPNQKIITIGSVCMTIGMANLILQIGNIISIWISHSIQLGNQNQIEICNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18739 - protein, 469 aa, Artificial Sequence; identical to SEQ ID NO: 16738
  neuraminidase__InfluenzaA__ADG42686

SEQ ID NO: 18740 - protein, 469 aa, Artificial Sequence; identical to SEQ ID NO: 18315
  neuraminidase__InfluenzaA__ADG42696

SEQ ID NO: 18741 - protein, 469 aa, Artificial Sequence; identical to SEQ ID NO: 18519
  neuraminidase__InfluenzaA__ADG42706

SEQ ID NO: 18742 - protein, 469 aa, Artificial Sequence; identical to SEQ ID NO: 16738
  neuraminidase__InfluenzaA__ADG42716

SEQ ID NO: 18743 - protein, 469 aa, Artificial Sequence; identical to SEQ ID NO: 18026
  neuraminidase__InfluenzaA__ADG42726

SEQ ID NO: 18744 - protein, 469 aa, Artificial Sequence; identical to SEQ ID NO: 17321
  neuraminidase__InfluenzaA__ADG42746

SEQ ID NO: 18745 - protein, 469 aa, Artificial Sequence; identical to SEQ ID NO: 18251
  neuraminidase__InfluenzaA__ADG42756

SEQ ID NO: 18746 - protein, 469 aa, Artificial Sequence; identical to SEQ ID NO: 18026
  neuraminidase__InfluenzaA__ADG42766

SEQ ID NO: 18747 - protein, 469 aa, Artificial Sequence; identical to SEQ ID NO: 18026
  neuraminidase__InfluenzaA__ADG42776

SEQ ID NO: 18748 - protein, 469 aa, Artificial Sequence; identical to SEQ ID NO: 18026
  neuraminidase__InfluenzaA__ADG42796

SEQ ID NO: 18749 - protein, 469 aa, Artificial Sequence
  neuraminidase__InfluenzaA__ADG42806
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVSWSWPDGAELPFTIDK

SEQ ID NO: 18750 - protein, 469 aa, Artificial Sequence; identical to SEQ ID NO: 16738
  neuraminidase__InfluenzaA__ADG42816

SEQ ID NO: 18751 - protein, 469 aa, Artificial Sequence; identical to SEQ ID NO: 16738
  neuraminidase__InfluenzaA__ADG42826

SEQ ID NO: 18752 - protein, 469 aa, Artificial Sequence; identical to SEQ ID NO: 16738
  neuraminidase__InfluenzaA__ADG42836

SEQ ID NO: 18753 - protein, 469 aa, Artificial Sequence; identical to SEQ ID NO: 18354
  neuraminidase__InfluenzaA__ADG42846

SEQ ID NO: 18754 - protein, 469 aa, Artificial Sequence; identical to SEQ ID NO: 16738
  neuraminidase__InfluenzaA__ADG42856

SEQ ID NO: 18755 - protein, 469 aa, Artificial Sequence; identical to SEQ ID NO: 18350
  neuraminidase__InfluenzaA__ADG42866

SEQ ID NO: 18756 - protein, 469 aa, Artificial Sequence; identical to SEQ ID NO: 16738
  neuraminidase__InfluenzaA__ADG42876

SEQ ID NO: 18757 - protein, 469 aa, Artificial Sequence; identical to SEQ ID NO: 18387
  neuraminidase__InfluenzaA__ADG42886

SEQ ID NO: 18758 - protein, 469 aa, Artificial Sequence; identical to SEQ ID NO: 18330
  neuraminidase__InfluenzaA__ADG42896

SEQ ID NO: 18759 - protein, 469 aa, Artificial Sequence; identical to SEQ ID NO: 18330
  neuraminidase__InfluenzaA__ADG42906

SEQ ID NO: 18760 - protein, 469 aa, Artificial Sequence; identical to SEQ ID NO: 16738
  neuraminidase__InfluenzaA__ADG42916

SEQ ID NO: 18761 - protein, 469 aa, Artificial Sequence; identical to SEQ ID NO: 16738
  neuraminidase__InfluenzaA__ADG42926

SEQ ID NO: 18762 - protein, 469 aa, Artificial Sequence; identical to SEQ ID NO: 16738
  neuraminidase__InfluenzaA__ADG58909

SEQ ID NO: 18763 - protein, 469 aa, Artificial Sequence; identical to SEQ ID NO: 16738
  neuraminidase__InfluenzaA__ADG58910

SEQ ID NO: 18764 - protein, 469 aa, Artificial Sequence
  neuraminidase__InfluenzaA__ADG58913
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVTFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWIELIRGRPKENTIWTSGSSISFCGVNSDTVGWSWPDGAELPFTIDK

SEQ ID NO: 18765 - protein, 469 aa, Artificial Sequence; identical to SEQ ID NO: 16738
  neuraminidase__InfluenzaA__ADG58914

SEQ ID NO: 18766 - protein, 469 aa, Artificial Sequence; identical to SEQ ID NO: 16738
  neuraminidase__InfluenzaA__ADG58916

SEQ ID NO: 18767 - protein, 469 aa, Artificial Sequence; identical to SEQ ID NO: 16738
  neuraminidase__InfluenzaA__ADG58917

SEQ ID NO: 18768 - protein, 469 aa, Artificial Sequence
  neuraminidase__InfluenzaA__ADG58918
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVTFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18769 - protein, 469 aa, Artificial Sequence; identical to SEQ ID NO: 18764
  neuraminidase__InfluenzaA__ADG58919

SEQ ID NO: 18770 - protein, 469 aa, Artificial Sequence; identical to SEQ ID NO: 16893
  neuraminidase__InfluenzaA__ADG58920

SEQ ID NO: 18771 - protein, 469 aa, Artificial Sequence; identical to SEQ ID NO: 16893
  neuraminidase__InfluenzaA__ADG58921

SEQ ID NO: 18772 - protein, 469 aa, Artificial Sequence; identical to SEQ ID NO: 16893
  neuraminidase__InfluenzaA__ADG58922

SEQ ID NO: 18773 - protein, 469 aa, Artificial Sequence; identical to SEQ ID NO: 16893
  neuraminidase__InfluenzaA__ADG58923

SEQ ID NO: 18774 - protein, 469 aa, Artificial Sequence; identical to SEQ ID NO: 16893
  neuraminidase__InfluenzaA__ADG58924

SEQ ID NO: 18775 - protein, 469 aa, Artificial Sequence; identical to SEQ ID NO: 16893
  neuraminidase__InfluenzaA__ADG58925

SEQ ID NO: 18776 - protein, 469 aa, Artificial Sequence; identical to SEQ ID NO: 16893
  neuraminidase__InfluenzaA__ADG58926

SEQ ID NO: 18777 - protein, 469 aa, Artificial Sequence; identical to SEQ ID NO: 16893
  neuraminidase__InfluenzaA__ADG58927

SEQ ID NO: 18778 - protein, 469 aa, Artificial Sequence; identical to SEQ ID NO: 17756
  neuraminidase__InfluenzaA__ADG58928

SEQ ID NO: 18779 - protein, 469 aa, Artificial Sequence; identical to SEQ ID NO: 17756
  neuraminidase__InfluenzaA__ADG58929

SEQ ID NO: 18780 - protein, 469 aa, Artificial Sequence
  neuraminidase__InfluenzaA__ADG58931
MNPNQKIITIGSVCMTIGMANLILQIGNTISIWINHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18781 - protein, 469 aa, Artificial Sequence; identical to SEQ ID NO: 18780
  neuraminidase__InfluenzaA__ADG58932

SEQ ID NO: 18782 - protein, 469 aa, Artificial Sequence; identical to SEQ ID NO: 18780
  neuraminidase__InfluenzaA__ADG58933

SEQ ID NO: 18783 - protein, 469 aa, Artificial Sequence; identical to SEQ ID NO: 18780
  neuraminidase__InfluenzaA__ADG58934

SEQ ID NO: 18784 - protein, 469 aa, Artificial Sequence; identical to SEQ ID NO: 18780
  neuraminidase__InfluenzaA__ADG58935

SEQ ID NO: 18785 - protein, 469 aa, Artificial Sequence; identical to SEQ ID NO: 18780
  neuraminidase__InfluenzaA__ADG58936

SEQ ID NO: 18786 - protein, 469 aa, Artificial Sequence; identical to SEQ ID NO: 18780
  neuraminidase__InfluenzaA__ADG58937

SEQ ID NO: 18787 - protein, 469 aa, Artificial Sequence; identical to SEQ ID NO: 18780
  neuraminidase__InfluenzaA__ADG58938

SEQ ID NO: 18788 - protein, 469 aa, Artificial Sequence
  neuraminidase__InfluenzaA__ADG59589
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAMAVLKYNGIITDTIKSWRNNILRTQESECACVNGSCFTVMTDGPSDGQASYKIFRIEKGKVVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18789 - protein, 469 aa, Artificial Sequence; identical to SEQ ID NO: 16738
  neuraminidase__InfluenzaA__ADG59590

SEQ ID NO: 18790 - protein, 469 aa, Artificial Sequence; identical to SEQ ID NO: 16738
  neuraminidase__InfluenzaA__ADG59591

SEQ ID NO: 18791 - protein, 469 aa, Artificial Sequence; identical to SEQ ID NO: 16738
  neuraminidase__InfluenzaA__ADG59592

SEQ ID NO: 18792 - protein, 469 aa, Artificial Sequence; identical to SEQ ID NO: 18640
  neuraminidase__InfluenzaA__ADG59593

SEQ ID NO: 18793 - protein, 469 aa, Artificial Sequence; identical to SEQ ID NO: 17915
  neuraminidase__InfluenzaA__ADG59594

SEQ ID NO: 18794 - protein, 469 aa, Artificial Sequence; identical to SEQ ID NO: 17915
  neuraminidase__InfluenzaA__ADG59595

SEQ ID NO: 18795 - protein, 469 aa, Artificial Sequence
  neuraminidase__InfluenzaA__ADG59596
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDRTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18796 - protein, 469 aa, Artificial Sequence; identical to SEQ ID NO: 16738
  neuraminidase__InfluenzaA__ADG59597

SEQ ID NO: 18797 - protein, 469 aa, Artificial Sequence; identical to SEQ ID NO: 16738
  neuraminidase__InfluenzaA__ADG59598

SEQ ID NO: 18798 - protein, 469 aa, Artificial Sequence; identical to SEQ ID NO: 17913
  neuraminidase__InfluenzaA__ADG59599

SEQ ID NO: 18799 - protein, 469 aa, Artificial Sequence; identical to SEQ ID NO: 16738
  neuraminidase__InfluenzaA__ADG59601

SEQ ID NO: 18800 - protein, 469 aa, Artificial Sequence; identical to SEQ ID NO: 18640
  neuraminidase__InfluenzaA__ADG59602

SEQ ID NO: 18801 - protein, 469 aa, Artificial Sequence; identical to SEQ ID NO: 18640
  neuraminidase__InfluenzaA__ADG59603

SEQ ID NO: 18802 - protein, 469 aa, Artificial Sequence; identical to SEQ ID NO: 16738
  neuraminidase__InfluenzaA__ADG59604

SEQ ID NO: 18803 - protein, 469 aa, Artificial Sequence; identical to SEQ ID NO: 16738
  neuraminidase__InfluenzaA__ADG59605

SEQ ID NO: 18804 - protein, 469 aa, Artificial Sequence; identical to SEQ ID NO: 17756
  neuraminidase__InfluenzaA__ADG59606

SEQ ID NO: 18805 - protein, 469 aa, Artificial Sequence; identical to SEQ ID NO: 16738
  neuraminidase__InfluenzaA__ADG59607

SEQ ID NO: 18806 - protein, 469 aa, Artificial Sequence; identical to SEQ ID NO: 16738
  neuraminidase__InfluenzaA__ADG59608

SEQ ID NO: 18807 - protein, 469 aa, Artificial Sequence; identical to SEQ ID NO: 17559
  neuraminidase__InfluenzaA__ADG59609

SEQ ID NO: 18808 - protein, 469 aa, Artificial Sequence; identical to SEQ ID NO: 18640
  neuraminidase__InfluenzaA__ADG59610

SEQ ID NO: 18809 - protein, 469 aa, Artificial Sequence; identical to SEQ ID NO: 17756
  neuraminidase__InfluenzaA__ADG59611

SEQ ID NO: 18810 - protein, 469 aa, Artificial Sequence; identical to SEQ ID NO: 18640
  neuraminidase__InfluenzaA__ADG59612

SEQ ID NO: 18811 - protein, 469 aa, Artificial Sequence
  neuraminidase__InfluenzaA__ADG59613
MNPNQKIITIGSVCMTIGMTNLILQLGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNSFSIKQDIVGINEWSGYSGSFVQHPELTGLDCIRPCFWVELIRGRPKENTVWTSGSSISFCGVNSDTVGWSWPDGAELPFTIDK

SEQ ID NO: 18812 - protein, 469 aa, Artificial Sequence; identical to SEQ ID NO: 17913
  neuraminidase__InfluenzaA__ADG59614

SEQ ID NO: 18813 - protein, 469 aa, Artificial Sequence; identical to SEQ ID NO: 16738
  neuraminidase__InfluenzaA__ADH01811

SEQ ID NO: 18814 - protein, 469 aa, Artificial Sequence; identical to SEQ ID NO: 16738
  neuraminidase__InfluenzaA__ADH01821

SEQ ID NO: 18815 - protein, 469 aa, Artificial Sequence; identical to SEQ ID NO: 16738
  neuraminidase__InfluenzaA__ADH01831

SEQ ID NO: 18816 - protein, 469 aa, Artificial Sequence; identical to SEQ ID NO: 16738
  neuraminidase__InfluenzaA__ADH01841

SEQ ID NO: 18817 - protein, 469 aa, Artificial Sequence; identical to SEQ ID NO: 16738
  neuraminidase__InfluenzaA__ADH01851

SEQ ID NO: 18818 - protein, 469 aa, Artificial Sequence; identical to SEQ ID NO: 16738
  neuraminidase__InfluenzaA__ADH01861

SEQ ID NO: 18819 - protein, 469 aa, Artificial Sequence; identical to SEQ ID NO: 16738
  neuraminidase__InfluenzaA__ADH01871

SEQ ID NO: 18820 - protein, 469 aa, Artificial Sequence; identical to SEQ ID NO: 16738
  neuraminidase__InfluenzaA__ADH01881

SEQ ID NO: 18821 - protein, 469 aa, Artificial Sequence; identical to SEQ ID NO: 16738
  neuraminidase__InfluenzaA__ADH01891

SEQ ID NO: 18822 - protein, 469 aa, Artificial Sequence; identical to SEQ ID NO: 16738
  neuraminidase__InfluenzaA__ADH01901

SEQ ID NO: 18823 - protein, 469 aa, Artificial Sequence; identical to SEQ ID NO: 16738
  neuraminidase__InfluenzaA__ADH01911

SEQ ID NO: 18824 - protein, 469 aa, Artificial Sequence; identical to SEQ ID NO: 16738
  neuraminidase__InfluenzaA__ADH01921

SEQ ID NO: 18825 - protein, 469 aa, Artificial Sequence; identical to SEQ ID NO: 16738
  neuraminidase__InfluenzaA__ADH01931

SEQ ID NO: 18826 - protein, 469 aa, Artificial Sequence; identical to SEQ ID NO: 18629
  neuraminidase__InfluenzaA__ADH01941

SEQ ID NO: 18827 - protein, 469 aa, Artificial Sequence; identical to SEQ ID NO: 16738
  neuraminidase__InfluenzaA__ADH01951

SEQ ID NO: 18828 - protein, 469 aa, Artificial Sequence; identical to SEQ ID NO: 16738
  neuraminidase__InfluenzaA__ADH01961

SEQ ID NO: 18829 - protein, 469 aa, Artificial Sequence
  neuraminidase__InfluenzaA__ADH01981
MNPNQKIITIGSACMTIGMANLILQIGNIISIWISHSIQLGNQNQTETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18830 - protein, 469 aa, Artificial Sequence; identical to SEQ ID NO: 18026
  neuraminidase__InfluenzaA__ADH01991

SEQ ID NO: 18831 - protein, 469 aa, Artificial Sequence; identical to SEQ ID NO: 18695
  neuraminidase__InfluenzaA__ADH02011

SEQ ID NO: 18832 - protein, 469 aa, Artificial Sequence; identical to SEQ ID NO: 17915
  neuraminidase__InfluenzaA__ADH02021

SEQ ID NO: 18833 - protein, 469 aa, Artificial Sequence; identical to SEQ ID NO: 16738
  neuraminidase__InfluenzaA__ADI24510

SEQ ID NO: 18834 - protein, 469 aa, Artificial Sequence; identical to SEQ ID NO: 16738
  neuraminidase__InfluenzaA__ADI24516

SEQ ID NO: 18835 - protein, 469 aa, Artificial Sequence; identical to SEQ ID NO: 16738
  neuraminidase__InfluenzaA__ADI24518

SEQ ID NO: 18836 - protein, 469 aa, Artificial Sequence; identical to SEQ ID NO: 16738
  neuraminidase__InfluenzaA__ADI24522

SEQ ID NO: 18837 - protein, 469 aa, Artificial Sequence; identical to SEQ ID NO: 16738
  neuraminidase__InfluenzaA__ADI24524

SEQ ID NO: 18838 - protein, 469 aa, Artificial Sequence; identical to SEQ ID NO: 16738
  neuraminidase__InfluenzaA__ADI24526

SEQ ID NO: 18839 - protein, 469 aa, Artificial Sequence; identical to SEQ ID NO: 16738
  neuraminidase__InfluenzaA__ADI24528

SEQ ID NO: 18840 - protein, 469 aa, Artificial Sequence; identical to SEQ ID NO: 16738
  neuraminidase__InfluenzaA__ADI24530

SEQ ID NO: 18841 - protein, 469 aa, Artificial Sequence
  neuraminidase__InfluenzaA__ADI24532
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSSGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18842 - protein, 469 aa, Artificial Sequence; identical to SEQ ID NO: 16738
  neuraminidase__InfluenzaA__ADI24538

SEQ ID NO: 18843 - protein, 469 aa, Artificial Sequence; identical to SEQ ID NO: 16738
  neuraminidase__InfluenzaA__ADI24548

SEQ ID NO: 18844 - protein, 469 aa, Artificial Sequence; identical to SEQ ID NO: 16738
  neuraminidase__InfluenzaA__ADI24556

SEQ ID NO: 18845 - protein, 469 aa, Artificial Sequence; identical to SEQ ID NO: 16738
  neuraminidase__InfluenzaA__ADI24558

SEQ ID NO: 18846 - protein, 469 aa, Artificial Sequence; identical to SEQ ID NO: 16738
  neuraminidase__InfluenzaA__ADI24560

SEQ ID NO: 18847 - protein, 469 aa, Artificial Sequence; identical to SEQ ID NO: 16738
  neuraminidase__InfluenzaA__ADI24562

SEQ ID NO: 18848 - protein, 469 aa, Artificial Sequence; identical to SEQ ID NO: 16738
  neuraminidase__InfluenzaA__ADI24564

SEQ ID NO: 18849 - protein, 469 aa, Artificial Sequence; identical to SEQ ID NO: 16738
  neuraminidase__InfluenzaA__ADI24566

SEQ ID NO: 18850 - protein, 469 aa, Artificial Sequence; identical to SEQ ID NO: 16738
  neuraminidase__InfluenzaA__ADI24568

SEQ ID NO: 18851 - protein, 469 aa, Artificial Sequence; identical to SEQ ID NO: 16738
  neuraminidase__InfluenzaA__ADI24570

SEQ ID NO: 18852 - protein, 469 aa, Artificial Sequence; identical to SEQ ID NO: 16738
  neuraminidase__InfluenzaA__ADI24572

SEQ ID NO: 18853 - protein, 469 aa, Artificial Sequence; identical to SEQ ID NO: 16738
  neuraminidase__InfluenzaA__ADI24574

SEQ ID NO: 18854 - protein, 469 aa, Artificial Sequence; identical to SEQ ID NO: 16738
  neuraminidase__InfluenzaA__ADI24576

SEQ ID NO: 18855 - protein, 469 aa, Artificial Sequence; identical to SEQ ID NO: 16738
  neuraminidase__InfluenzaA__ADI24580

SEQ ID NO: 18856 - protein, 469 aa, Artificial Sequence; identical to SEQ ID NO: 17913
  neuraminidase__InfluenzaA__ADI24582

SEQ ID NO: 18857 - protein, 469 aa, Artificial Sequence
  neuraminidase__InfluenzaA__ADI24584
MNPNQKIITIGSVCMTIGMANLILQIGNIISIWISHSIQLGNQNQIETCNQSVITYENNTWVNQTYVNISNTNFAAGQSVVPVKLAGNSSLCPVNGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18858 - protein, 469 aa, Artificial Sequence; identical to SEQ ID NO: 17092
  neuraminidase__InfluenzaA__ADI24592

SEQ ID NO: 18859 - protein, 469 aa, Artificial Sequence; identical to SEQ ID NO: 16738
  neuraminidase__InfluenzaA__ADI24598

SEQ ID NO: 18860 - protein, 469 aa, Artificial Sequence; identical to SEQ ID NO: 16738
  neuraminidase__InfluenzaA__ADI24604

SEQ ID NO: 18861 - protein, 469 aa, Artificial Sequence; identical to SEQ ID NO: 16738
  neuraminidase__InfluenzaA__ADI24620

SEQ ID NO: 18862 - protein, 469 aa, Artificial Sequence; identical to SEQ ID NO: 16738
  neuraminidase__InfluenzaA__ADI24622

SEQ ID NO: 18863 - protein, 469 aa, Artificial Sequence; identical to SEQ ID NO: 17092
  neuraminidase__InfluenzaA__ADI46780

SEQ ID NO: 18864 - protein, 469 aa, Artificial Sequence
  neuraminidase__InfluenzaA__ADI46789
MNPNQKIITIGSVCMTIGMANLMLQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNEQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18865 - protein, 469 aa, Artificial Sequence; identical to SEQ ID NO: 16738
  neuraminidase__InfluenzaA__ADI48185

SEQ ID NO: 18866 - protein, 469 aa, Artificial Sequence; identical to SEQ ID NO: 16738
  neuraminidase__InfluenzaA__ADI48187

SEQ ID NO: 18867 - protein, 469 aa, Artificial Sequence; identical to SEQ ID NO: 16738
  neuraminidase__InfluenzaA__ADI48189

SEQ ID NO: 18868 - protein, 469 aa, Artificial Sequence; identical to SEQ ID NO: 16738
  neuraminidase__InfluenzaA__ADI48191

SEQ ID NO: 18869 - protein, 469 aa, Artificial Sequence; identical to SEQ ID NO: 16738
  neuraminidase__InfluenzaA__ADI48193

SEQ ID NO: 18870 - protein, 469 aa, Artificial Sequence; identical to SEQ ID NO: 16738
  neuraminidase__InfluenzaA__ADI48195

SEQ ID NO: 18871 - protein, 469 aa, Artificial Sequence
  neuraminidase__InfluenzaA__ADI48197
MNPNQKIITIGSVCMTIGMANLILQIGNIISIWISHSIQFGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18872 - protein, 469 aa, Artificial Sequence; identical to SEQ ID NO: 16738
  neuraminidase__InfluenzaA__ADI48199

SEQ ID NO: 18873 - protein, 469 aa, Artificial Sequence; identical to SEQ ID NO: 16738
  neuraminidase__InfluenzaA__ADI48201

SEQ ID NO: 18874 - protein, 469 aa, Artificial Sequence; identical to SEQ ID NO: 16738
  neuraminidase__InfluenzaA__ADI48203

SEQ ID NO: 18875 - protein, 469 aa, Artificial Sequence
  neuraminidase__InfluenzaA__ADI48205
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSHLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18876 - protein, 469 aa, Artificial Sequence; identical to SEQ ID NO: 16738
  neuraminidase__InfluenzaA__ADI48207

SEQ ID NO: 18877 - protein, 469 aa, Artificial Sequence; identical to SEQ ID NO: 16738
  neuraminidase__InfluenzaA__ADI48209

SEQ ID NO: 18878 - protein, 469 aa, Artificial Sequence; identical to SEQ ID NO: 16738
  neuraminidase__InfluenzaA__ADI48211

SEQ ID NO: 18879 - protein, 469 aa, Artificial Sequence; identical to SEQ ID NO: 16738
  neuraminidase__InfluenzaA__ADI48213

SEQ ID NO: 18880 - protein, 469 aa, Artificial Sequence; identical to SEQ ID NO: 16738
  neuraminidase__InfluenzaA__ADI48215

SEQ ID NO: 18881 - protein, 469 aa, Artificial Sequence; identical to SEQ ID NO: 16738
  neuraminidase__InfluenzaA__ADI48217

SEQ ID NO: 18882 - protein, 469 aa, Artificial Sequence; identical to SEQ ID NO: 16738
  neuraminidase__InfluenzaA__ADI48219

SEQ ID NO: 18883 - protein, 469 aa, Artificial Sequence; identical to SEQ ID NO: 16738
  neuraminidase__InfluenzaA__ADI48221

SEQ ID NO: 18884 - protein, 469 aa, Artificial Sequence; identical to SEQ ID NO: 16738
  neuraminidase__InfluenzaA__ADI48625

SEQ ID NO: 18885 - protein, 469 aa, Artificial Sequence; identical to SEQ ID NO: 16738
  neuraminidase__InfluenzaA__ADI48635

SEQ ID NO: 18886 - protein, 469 aa, Artificial Sequence; identical to SEQ ID NO: 16738
  neuraminidase__InfluenzaA__ADI48655

SEQ ID NO: 18887 - protein, 469 aa, Artificial Sequence; identical to SEQ ID NO: 16738
  neuraminidase__InfluenzaA__ADI48665

SEQ ID NO: 18888 - protein, 469 aa, Artificial Sequence
  neuraminidase__InfluenzaA__ADI48675
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRLKENTIWTSGSSISFCGVNSDTVGWSWPDGAELPFTIDK

SEQ ID NO: 18889 - protein, 469 aa, Artificial Sequence
  neuraminidase__InfluenzaA__ADI48685
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGACFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18890 - protein, 469 aa, Artificial Sequence; identical to SEQ ID NO: 16738
  neuraminidase__InfluenzaA__ADI48695

SEQ ID NO: 18891 - protein, 469 aa, Artificial Sequence; identical to SEQ ID NO: 16728
  neuraminidase__InfluenzaA__ADI48705

SEQ ID NO: 18892 - protein, 469 aa, Artificial Sequence; identical to SEQ ID NO: 16738
  neuraminidase__InfluenzaA__ADI48715

SEQ ID NO: 18893 - protein, 469 aa, Artificial Sequence; identical to SEQ ID NO: 16738
  neuraminidase__InfluenzaA__ADI48725

SEQ ID NO: 18894 - protein, 469 aa, Artificial Sequence; identical to SEQ ID NO: 16738
  neuraminidase__InfluenzaA__ADI48735

SEQ ID NO: 18895 - protein, 469 aa, Artificial Sequence; identical to SEQ ID NO: 16738
  neuraminidase__InfluenzaA__ADI48745

SEQ ID NO: 18896 - protein, 469 aa, Artificial Sequence
  neuraminidase__InfluenzaA__ADI48755
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIISDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18897 - protein, 469 aa, Artificial Sequence; identical to SEQ ID NO: 16738
  neuraminidase__InfluenzaA__ADI48765

SEQ ID NO: 18898 - protein, 469 aa, Artificial Sequence; identical to SEQ ID NO: 16738
  neuraminidase__InfluenzaA__ADI48775

SEQ ID NO: 18899 - protein, 469 aa, Artificial Sequence; identical to SEQ ID NO: 16738
  neuraminidase__InfluenzaA__ADI48785

SEQ ID NO: 18900 - protein, 469 aa, Artificial Sequence; identical to SEQ ID NO: 16738
  neuraminidase__InfluenzaA__ADI48795

SEQ ID NO: 18901 - protein, 469 aa, Artificial Sequence; identical to SEQ ID NO: 16738
  neuraminidase__InfluenzaA__ADI49032

SEQ ID NO: 18902 - protein, 469 aa, Artificial Sequence; identical to SEQ ID NO: 16738
  neuraminidase__InfluenzaA__ADI49243

SEQ ID NO: 18903 - protein, 469 aa, Artificial Sequence; identical to SEQ ID NO: 16738
  neuraminidase__InfluenzaA__ADI49263

SEQ ID NO: 18904 - protein, 469 aa, Artificial Sequence; identical to SEQ ID NO: 16738
  neuraminidase__InfluenzaA__ADI49273

SEQ ID NO: 18905 - protein, 469 aa, Artificial Sequence; identical to SEQ ID NO: 16738
  neuraminidase__InfluenzaA__ADI49283

SEQ ID NO: 18906 - protein, 469 aa, Artificial Sequence; identical to SEQ ID NO: 16738
  neuraminidase__InfluenzaA__ADI49315

SEQ ID NO: 18907 - protein, 469 aa, Artificial Sequence; identical to SEQ ID NO: 16738
  neuraminidase__InfluenzaA__ADI49325

SEQ ID NO: 18908 - protein, 469 aa, Artificial Sequence; identical to SEQ ID NO: 16738
  neuraminidase__InfluenzaA__ADI49335

SEQ ID NO: 18909 - protein, 469 aa, Artificial Sequence
  neuraminidase__InfluenzaA__ADI49345
MNPNQKIITIGSVCMTIGMANLILQIGNIISIWISHSIQLGNQNQIETCNQSVITYENNTWVNQTYVNISNTNLAAGQSVVSVKLAGNSSLCPVSGWAIYSKDNSIRIGSKGDVFVIREPFISCSPLECRTFFLTQGALLNDKHSNGTIKDRSPYRTLMSCPIGDVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18910 - protein, 469 aa, Artificial Sequence; identical to SEQ ID NO: 16738
  neuraminidase__InfluenzaA__ADI49355

SEQ ID NO: 18911 - protein, 469 aa, Artificial Sequence; identical to SEQ ID NO: 16738
  neuraminidase__InfluenzaA__ADI49365

SEQ ID NO: 18912 - protein, 469 aa, Artificial Sequence; identical to SEQ ID NO: 16738
  neuraminidase__InfluenzaA__ADI49375

SEQ ID NO: 18913 - protein, 469 aa, Artificial Sequence; identical to SEQ ID NO: 16738
  neuraminidase__InfluenzaA__ADI49385

SEQ ID NO: 18914 - protein, 469 aa, Artificial Sequence
  neuraminidase__InfluenzaA__ADI49395
MNPNQKIITIGSVCMTIGMANLILQIGNMISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVELNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18915 - protein, 469 aa, Artificial Sequence; identical to SEQ ID NO: 16738
  neuraminidase__InfluenzaA__ADI49720

SEQ ID NO: 18916 - protein, 469 aa, Artificial Sequence; identical to SEQ ID NO: 16738
  neuraminidase__InfluenzaA__ADI49730

SEQ ID NO: 18917 - protein, 469 aa, Artificial Sequence; identical to SEQ ID NO: 16738
  neuraminidase__InfluenzaA__ADI49740

SEQ ID NO: 18918 - protein, 469 aa, Artificial Sequence; identical to SEQ ID NO: 16738
  neuraminidase__InfluenzaA__ADI49750

SEQ ID NO: 18919 - protein, 469 aa, Artificial Sequence; identical to SEQ ID NO: 16738
  neuraminidase__InfluenzaA__ADI49760

SEQ ID NO: 18920 - protein, 469 aa, Artificial Sequence; identical to SEQ ID NO: 16768
  neuraminidase__InfluenzaA__ADI49780

SEQ ID NO: 18921 - protein, 469 aa, Artificial Sequence; identical to SEQ ID NO: 16728
  neuraminidase__InfluenzaA__ADI49790

SEQ ID NO: 18922 - protein, 469 aa, Artificial Sequence; identical to SEQ ID NO: 16738
  neuraminidase__InfluenzaA__ADI49821

SEQ ID NO: 18923 - protein, 469 aa, Artificial Sequence; identical to SEQ ID NO: 16728
  neuraminidase__InfluenzaA__ADI50029

SEQ ID NO: 18924 - protein, 469 aa, Artificial Sequence
  neuraminidase__InfluenzaA__ADI52830
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGDELPFTIDK

SEQ ID NO: 18925 - protein, 469 aa, Artificial Sequence
  neuraminidase__InfluenzaA__ADI52831
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSVSSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18926 - protein, 469 aa, Artificial Sequence; identical to SEQ ID NO: 16738
  neuraminidase__InfluenzaA__ADI52832

SEQ ID NO: 18927 - protein, 469 aa, Artificial Sequence
  neuraminidase__InfluenzaA__ADI52833
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEAPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18928 - protein, 470 aa, Artificial Sequence; identical to SEQ ID NO: 17461
  neuraminidase__InfluenzaA__ADI75821

SEQ ID NO: 18929 - protein, 469 aa, Artificial Sequence; identical to SEQ ID NO: 17905
  neuraminidase__InfluenzaA__ADI75832

SEQ ID NO: 18930 - protein, 470 aa, Artificial Sequence
  neuraminidase__InfluenzaA__ADI75854
MNPNQKIITIGSISIAIGIISLMLQIGSIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 18931 - protein, 469 aa, Artificial Sequence
  neuraminidase__InfluenzaA__ADI75876
MNPNQKIITIGSVSLTISTICFFMQIAILITTVTLHFKQYEFNSPPNNQVMLCEPTIIERNITEIVYLTNTTIEKEVCPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSVVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 18932 - protein, 469 aa, Artificial Sequence; identical to SEQ ID NO: 17905
  neuraminidase__InfluenzaA__ADI75887

SEQ ID NO: 18933 - protein, 470 aa, Artificial Sequence; identical to SEQ ID NO: 17461
  neuraminidase__InfluenzaA__ADI75909

SEQ ID NO: 18934 - protein, 469 aa, Artificial Sequence; identical to SEQ ID NO: 18484
  neuraminidase__InfluenzaA__ADI75920

SEQ ID NO: 18935 - protein, 470 aa, Artificial Sequence; identical to SEQ ID NO: 17461
  neuraminidase__InfluenzaA__ADI77352

SEQ ID NO: 18936 - protein, 469 aa, Artificial Sequence; identical to SEQ ID NO: 16738
  neuraminidase__InfluenzaA__ADI77363

SEQ ID NO: 18937 - protein, 469 aa, Artificial Sequence; identical to SEQ ID NO: 17915
  neuraminidase__InfluenzaA__ADI99500

SEQ ID NO: 18938 - protein, 469 aa, Artificial Sequence
  neuraminidase__InfluenzaA__ADI99553
MNPNQKIITIGSVCMTIGMANLILQIGNIISIWISHSIQLGNQNQIETCNQSVITYENNTWVNQTYVNISNTNFAAGQSVDSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18939 - protein, 469 aa, Artificial Sequence
  neuraminidase__InfluenzaA__ADI99563
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEVNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18940 - protein, 469 aa, Artificial Sequence; identical to SEQ ID NO: 18939
  neuraminidase__InfluenzaA__ADI99573

SEQ ID NO: 18941 - protein, 469 aa, Artificial Sequence; identical to SEQ ID NO: 18939
  neuraminidase__InfluenzaA__ADI99583

SEQ ID NO: 18942 - protein, 469 aa, Artificial Sequence; identical to SEQ ID NO: 18089
  neuraminidase__InfluenzaA__ADI99593

SEQ ID NO: 18943 - protein, 469 aa, Artificial Sequence
  neuraminidase__InfluenzaA__ADI99613
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSIISFCGVNSDTVGWSWPDGAELPFTIDK

SEQ ID NO: 18944 - protein, 469 aa, Artificial Sequence
  neuraminidase__InfluenzaA__ADI99623
MNPNQKIITIGSVCMTIGMANLILQIGNIISIWISHSIQLGNQNQIETCNQSVITYENNTWVNQTYVNISNTNFAAGQSVVSMKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSNEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18945 - protein, 469 aa, Artificial Sequence; identical to SEQ ID NO: 18026
  neuraminidase__InfluenzaA__ADI99633

SEQ ID NO: 18946 - protein, 469 aa, Artificial Sequence; identical to SEQ ID NO: 18089
  neuraminidase__InfluenzaA__ADI99643

SEQ ID NO: 18947 - protein, 469 aa, Artificial Sequence; identical to SEQ ID NO: 16738
  neuraminidase__InfluenzaA__ADI99653

SEQ ID NO: 18948 - protein, 469 aa, Artificial Sequence; identical to SEQ ID NO: 16738
  neuraminidase__InfluenzaA__ADI99663

SEQ ID NO: 18949 - protein, 469 aa, Artificial Sequence; identical to SEQ ID NO: 16738
  neuraminidase__InfluenzaA__ADI99673

SEQ ID NO: 18950 - protein, 469 aa, Artificial Sequence; identical to SEQ ID NO: 16738
  neuraminidase__InfluenzaA__ADI99683

SEQ ID NO: 18951 - protein, 469 aa, Artificial Sequence; identical to SEQ ID NO: 18200
  neuraminidase__InfluenzaA__ADI99703

SEQ ID NO: 18952 - protein, 469 aa, Artificial Sequence; identical to SEQ ID NO: 16738
  neuraminidase__InfluenzaA__ADI99713

SEQ ID NO: 18953 - protein, 469 aa, Artificial Sequence; identical to SEQ ID NO: 16738
  neuraminidase__InfluenzaA__ADI99723

SEQ ID NO: 18954 - protein, 469 aa, Artificial Sequence; identical to SEQ ID NO: 16738
  neuraminidase__InfluenzaA__ADI99733

SEQ ID NO: 18955 - protein, 469 aa, Artificial Sequence; identical to SEQ ID NO: 16893
  neuraminidase__InfluenzaA__ADJ00487

SEQ ID NO: 18956 - protein, 469 aa, Artificial Sequence; identical to SEQ ID NO: 16893
  neuraminidase__InfluenzaA__ADJ00488

SEQ ID NO: 18957 - protein, 469 aa, Artificial Sequence; identical to SEQ ID NO: 16893
  neuraminidase__InfluenzaA__ADJ00489

SEQ ID NO: 18958 - protein, 469 aa, Artificial Sequence; identical to SEQ ID NO: 16893
  neuraminidase__InfluenzaA__ADJ00490

SEQ ID NO: 18959 - protein, 469 aa, Artificial Sequence; identical to SEQ ID NO: 16893
  neuraminidase__InfluenzaA__ADJ00491

SEQ ID NO: 18960 - protein, 469 aa, Artificial Sequence; identical to SEQ ID NO: 16738
  neuraminidase__InfluenzaA__ADJ18160

SEQ ID NO: 18961 - protein, 469 aa, Artificial Sequence; identical to SEQ ID NO: 16738
  neuraminidase__InfluenzaA__ADJ18161

SEQ ID NO: 18962 - protein, 469 aa, Artificial Sequence
  neuraminidase__InfluenzaA__ADJ18162
MIPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIRKPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18963 - protein, 469 aa, Artificial Sequence
  neuraminidase__InfluenzaA__ADJ18164
MNPKQKIITIGSVCMTIGMANLILQIGNIISIWISHSIQLGNQNQIETCNQSVITYENNTWVNQTYVNISNTNFAAGQSVVSVKLAGNSSLCSVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18964 - protein, 469 aa, Artificial Sequence; identical to SEQ ID NO: 16738
  neuraminidase__InfluenzaA__ADJ18166

SEQ ID NO: 18965 - protein, 469 aa, Artificial Sequence; identical to SEQ ID NO: 16738
  neuraminidase__InfluenzaA__ADJ18168

SEQ ID NO: 18966 - protein, 469 aa, Artificial Sequence; identical to SEQ ID NO: 16738
  neuraminidase__InfluenzaA__ADJ18170

SEQ ID NO: 18967 - protein, 469 aa, Artificial Sequence
  neuraminidase__InfluenzaA__ADJ18172
MNPNQKIITIGSVCMTIGMANLILRIGNIISIWISHSIQLGNQNQIETCNQSVITYENNTWVNQTYVNISNTNFAAGQSVVSVKLAGNSSLCPVSGWAIYRKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18968 - protein, 469 aa, Artificial Sequence; identical to SEQ ID NO: 16738
  neuraminidase__InfluenzaA__ADJ18174

SEQ ID NO: 18969 - protein, 469 aa, Artificial Sequence
  neuraminidase__InfluenzaA__ADJ18176
MNPNQKIITIGSVCMTIGMANLILQIGNIISIWISLSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18970 - protein, 469 aa, Artificial Sequence; identical to SEQ ID NO: 16511
  neuraminidase__InfluenzaA__ADJ37250

SEQ ID NO: 18971 - protein, 469 aa, Artificial Sequence
  neuraminidase__InfluenzaA__ADJ37252
MNPNQKIITIGSVSLTISTICFFMQIAILVTTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNIVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 18972 - protein, 469 aa, Artificial Sequence; identical to SEQ ID NO: 16738
  neuraminidase__InfluenzaA__ADJ37263

SEQ ID NO: 18973 - protein, 469 aa, Artificial Sequence; identical to SEQ ID NO: 16728
  neuraminidase__InfluenzaA__ADJ37273

SEQ ID NO: 18974 - protein, 469 aa, Artificial Sequence; identical to SEQ ID NO: 16738
  neuraminidase__InfluenzaA__ADJ40447

SEQ ID NO: 18975 - protein, 469 aa, Artificial Sequence; identical to SEQ ID NO: 16738
  neuraminidase__InfluenzaA__ADJ40457

SEQ ID NO: 18976 - protein, 469 aa, Artificial Sequence; identical to SEQ ID NO: 18089
  neuraminidase__InfluenzaA__ADJ40467

SEQ ID NO: 18977 - protein, 469 aa, Artificial Sequence
  neuraminidase__InfluenzaA__ADJ40477
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTMGWSWPDGAELPFTIDK

SEQ ID NO: 18978 - protein, 469 aa, Artificial Sequence; identical to SEQ ID NO: 16738
  neuraminidase__InfluenzaA__ADJ40487

SEQ ID NO: 18979 - protein, 469 aa, Artificial Sequence; identical to SEQ ID NO: 16738
  neuraminidase__InfluenzaA__ADJ40507

SEQ ID NO: 18980 - protein, 469 aa, Artificial Sequence; identical to SEQ ID NO: 16738
  neuraminidase__InfluenzaA__ADJ40517

SEQ ID NO: 18981 - protein, 469 aa, Artificial Sequence; identical to SEQ ID NO: 16738
  neuraminidase__InfluenzaA__ADJ40527

SEQ ID NO: 18982 - protein, 469 aa, Artificial Sequence
  neuraminidase__InfluenzaA__ADJ40537
MNPNQKIITIGSVCMTIGMANLILQIGNIISIWISHSIQLGNQNQIETCNQSVITYENNTWVNQTYVNISNTNFAAGQSGVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 18983 - protein, 469 aa, Artificial Sequence
  neuraminidase__InfluenzaA__ADJ40547
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIIKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 18984 - protein, 469 aa, Artificial Sequence; identical to SEQ ID NO: 16738
  neuraminidase__InfluenzaA__ADJ40557

SEQ ID NO: 18985 - protein, 469 aa, Artificial Sequence; identical to SEQ ID NO: 16738
  neuraminidase__InfluenzaA__ADJ40577

SEQ ID NO: 18986 - protein, 469 aa, Artificial Sequence; identical to SEQ ID NO: 16738
  neuraminidase__InfluenzaA__ADJ40587

SEQ ID NO: 18987 - protein, 469 aa, Artificial Sequence
  neuraminidase__InfluenzaA__ADJ40597
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFLIKQDIVGINEWSGYSGSFVQHPELTGLDCIRPCFWVELIRGRPKENTIWTSGSSISFCGVNSDTVGWSWPDGAELPFTIDK

SEQ ID NO: 18988 - protein, 469 aa, Artificial Sequence; identical to SEQ ID NO: 16738
  neuraminidase__InfluenzaA__ADJ40607

SEQ ID NO: 18989 - protein, 469 aa, Artificial Sequence; identical to SEQ ID NO: 16738
  neuraminidase__InfluenzaA__ADJ40617

SEQ ID NO: 18990 - protein, 469 aa, Artificial Sequence; identical to SEQ ID NO: 17092
  neuraminidase__InfluenzaA__ADJ40627

SEQ ID NO: 18991 - protein, 469 aa, Artificial Sequence; identical to SEQ ID NO: 16738
  neuraminidase__InfluenzaA__ADJ40637

SEQ ID NO: 18992 - protein, 469 aa, Artificial Sequence; identical to SEQ ID NO: 16738
  neuraminidase__InfluenzaA__ADJ40657

SEQ ID NO: 18993 - protein, 469 aa, Artificial Sequence; identical to SEQ ID NO: 16738
  neuraminidase__InfluenzaA__ADJ40667

SEQ ID NO: 18994 - protein, 469 aa, Artificial Sequence; identical to SEQ ID NO: 16738
  neuraminidase__InfluenzaA__ADJ40677

SEQ ID NO: 18995 - protein, 469 aa, Artificial Sequence
  neuraminidase__InfluenzaA__ADJ41819
MNPNQKIITIGSVSLTIATICFLMQIAILVTTVTLHFKQYECSSPPNNQVVPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPYRTLLMNELGVPFHLGTRQVCIAWSSSSCHDGKAWLHVCITGYDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKLQINRQVIVDSGNRSGYSGIFSVEGKSCINRCFYVELIRGREQETRVWWTSNSIVVFCGTSGTYGTGSWPDGADINLMPI

SEQ ID NO: 18996 - protein, 469 aa, Artificial Sequence; identical to SEQ ID NO: 16738
  neuraminidase__InfluenzaA__ADJ56642

SEQ ID NO: 18997 - protein, 469 aa, Artificial Sequence; identical to SEQ ID NO: 16738
  neuraminidase__InfluenzaA__ADJ56652

SEQ ID NO: 18998 - protein, 469 aa, Artificial Sequence; identical to SEQ ID NO: 16738
  neuraminidase__InfluenzaA__ADJ80637

SEQ ID NO: 18999 - protein, 469 aa, Artificial Sequence; identical to SEQ ID NO: 17756
  neuraminidase__InfluenzaA__ADJ80647

SEQ ID NO: 19000 - protein, 469 aa, Artificial Sequence; identical to SEQ ID NO: 17756
  neuraminidase__InfluenzaA__ADJ80657

SEQ ID NO: 19001 - protein, 469 aa, Artificial Sequence; identical to SEQ ID NO: 16738
  neuraminidase__InfluenzaA__ADJ80667

SEQ ID NO: 19002 - protein, 469 aa, Artificial Sequence; identical to SEQ ID NO: 18651
  neuraminidase__InfluenzaA__ADJ80677

SEQ ID NO: 19003 - protein, 469 aa, Artificial Sequence; identical to SEQ ID NO: 18026
  neuraminidase__InfluenzaA__ADJ80687

SEQ ID NO: 19004 - protein, 469 aa, Artificial Sequence
  neuraminidase__InfluenzaA__ADJ80697
MNPNQKIITIGSVCMTIGMANLILQIGNIISIWISHSIQLGNQNQIETCNQSVITYENNTWVNQTYVNISNTNFAAGQSVISVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19005 - protein, 469 aa, Artificial Sequence
  neuraminidase__InfluenzaA__ADJ80717
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAVYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19006 - protein, 469 aa, Artificial Sequence
  neuraminidase__InfluenzaA__ADJ80727
MNPNQKIITIGSVCMTIGMANLILQIGNIISIWISHSIQLGNQNQIETCNQSVITYENNTWVNQTYVNISNTNFAAGQSVVSVKLAGNSSLCPVSGWVIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19007 - protein, 469 aa, Artificial Sequence; identical to SEQ ID NO: 17505
  neuraminidase__InfluenzaA__ADJ80737

SEQ ID NO: 19008 - protein, 469 aa, Artificial Sequence
  neuraminidase__InfluenzaA__ADJ80747
MNPNQKIITIGSVCMTIGMANLILQIGNIISIWISHSIQLGNQNQIETCNQSVITYENNTWVNQTYVNISNTNFAAGQSVVSVKLAGSSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIERGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVEINEWSGYSGSFVQHPELTGLDCIRPCFWVELIRGRPKENTIWTSGSSISFCGVNSDTVGWSWPDGAELPFTIDK

SEQ ID NO: 19009 - protein, 469 aa, Artificial Sequence; identical to SEQ ID NO: 16738
  neuraminidase__InfluenzaA__ADJ80757

SEQ ID NO: 19010 - protein, 469 aa, Artificial Sequence; identical to SEQ ID NO: 16738
  neuraminidase__InfluenzaA__ADJ80767

SEQ ID NO: 19011 - protein, 469 aa, Artificial Sequence; identical to SEQ ID NO: 17321
  neuraminidase__InfluenzaA__ADJ80777

SEQ ID NO: 19012 - protein, 469 aa, Artificial Sequence; identical to SEQ ID NO: 16738
  neuraminidase__InfluenzaA__ADJ80787

SEQ ID NO: 19013 - protein, 469 aa, Artificial Sequence
  neuraminidase__InfluenzaA__ADJ80797
MNPNQKIITIGSVCMTIGMANLILQIGNIISIWISHSIQLGNKNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19014 - protein, 469 aa, Artificial Sequence; identical to SEQ ID NO: 17756
  neuraminidase__InfluenzaA__ADJ80807

SEQ ID NO: 19015 - protein, 469 aa, Artificial Sequence; identical to SEQ ID NO: 16738
  neuraminidase__InfluenzaA__ADJ80817

SEQ ID NO: 19016 - protein, 469 aa, Artificial Sequence; identical to SEQ ID NO: 16738
  neuraminidase__InfluenzaA__ADJ80827

SEQ ID NO: 19017 - protein, 469 aa, Artificial Sequence; identical to SEQ ID NO: 18251
  neuraminidase__InfluenzaA__ADJ80837

SEQ ID NO: 19018 - protein, 469 aa, Artificial Sequence; identical to SEQ ID NO: 18749
  neuraminidase__InfluenzaA__ADJ80851

SEQ ID NO: 19019 - protein, 469 aa, Artificial Sequence
  neuraminidase__InfluenzaA__ADJ80861
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSPNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19020 - protein, 469 aa, Artificial Sequence; identical to SEQ ID NO: 19013
  neuraminidase__InfluenzaA__ADJ80871

SEQ ID NO: 19021 - protein, 469 aa, Artificial Sequence; identical to SEQ ID NO: 16738
  neuraminidase__InfluenzaA__ADJ80886

SEQ ID NO: 19022 - protein, 469 aa, Artificial Sequence
  neuraminidase__InfluenzaA__ADJ80896
MNPNQKIITIGSVCMTIGMANLILQIGNIISIWISHSIQLGNQNQIETCNQSIITYENNTWVNQTYVNISNTNFAAGQSVVSVKLTGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19023 - protein, 469 aa, Artificial Sequence
  neuraminidase__InfluenzaA__ADJ80913
MNPNQKIITIGSVCMTIGMANLILQIGNIISIWISHSIQLGNQNQIETCNQSVITYENNTWVNQTYVNISNTNFAAGQSVVSVKLAGSSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRSGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19024 - protein, 469 aa, Artificial Sequence; identical to SEQ ID NO: 16738
  neuraminidase__InfluenzaA__ADJ80930

SEQ ID NO: 19025 - protein, 469 aa, Artificial Sequence; identical to SEQ ID NO: 16738
  neuraminidase__InfluenzaA__ADJ80950

SEQ ID NO: 19026 - protein, 469 aa, Artificial Sequence; identical to SEQ ID NO: 18026
  neuraminidase__InfluenzaA__ADJ80960

SEQ ID NO: 19027 - protein, 469 aa, Artificial Sequence; identical to SEQ ID NO: 19013
  neuraminidase__InfluenzaA__ADJ80970

SEQ ID NO: 19028 - protein, 469 aa, Artificial Sequence; identical to SEQ ID NO: 16738
  neuraminidase__InfluenzaA__ADJ80980

SEQ ID NO: 19029 - protein, 469 aa, Artificial Sequence; identical to SEQ ID NO: 19013
  neuraminidase__InfluenzaA__ADJ80996

SEQ ID NO: 19030 - protein, 469 aa, Artificial Sequence
  neuraminidase__InfluenzaA__ADJ81006
MNPNQKIITIGSVCMTIGMANLILQVGNIISIWISHSIQLGNQNQIETCNQSIITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSTSSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19031 - protein, 469 aa, Artificial Sequence; identical to SEQ ID NO: 18749
  neuraminidase__InfluenzaA__ADJ81016

SEQ ID NO: 19032 - protein, 469 aa, Artificial Sequence; identical to SEQ ID NO: 18938
  neuraminidase__InfluenzaA__ADJ81026

SEQ ID NO: 19033 - protein, 469 aa, Artificial Sequence; identical to SEQ ID NO: 16738
  neuraminidase__InfluenzaA__ADJ81036

SEQ ID NO: 19034 - protein, 469 aa, Artificial Sequence
  neuraminidase__InfluenzaA__ADJ81046
MNPNQKIITIGSVCMTVGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSINSRNGFEMIWDPNGWTGTDNNFSIKQDIVGTNEWSGYSGSFVQHPELTGLDCIRPCFWVELIRGRPKENTIWTSGSSISFCGVNSDTVGWSWPDGAELPFTIDK

SEQ ID NO: 19035 - protein, 469 aa, Artificial Sequence
  neuraminidase__InfluenzaA__ADJ81056
MNPNQKIITIGSVCMTIGMANLILQIGNIISIWISHSIQLGNQNQIETCNQSVITYENNTWVNQTYVNISNTNFAAGQSVVPVKLAGSSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSINSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19036 - protein, 469 aa, Artificial Sequence; identical to SEQ ID NO: 18026
  neuraminidase__InfluenzaA__ADJ81066

SEQ ID NO: 19037 - protein, 469 aa, Artificial Sequence; identical to SEQ ID NO: 16599
  neuraminidase__InfluenzaA__ADJ84775

SEQ ID NO: 19038 - protein, 469 aa, Artificial Sequence
  neuraminidase__InfluenzaA__ADJ88785
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSVVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 19039 - protein, 469 aa, Artificial Sequence; identical to SEQ ID NO: 16738
  neuraminidase__InfluenzaA__ADK21716

SEQ ID NO: 19040 - protein, 469 aa, Artificial Sequence; identical to SEQ ID NO: 16738
  neuraminidase__InfluenzaA__ADK21726

SEQ ID NO: 19041 - protein, 469 aa, Artificial Sequence; identical to SEQ ID NO: 16738
  neuraminidase__InfluenzaA__ADK21736

SEQ ID NO: 19042 - protein, 469 aa, Artificial Sequence
  neuraminidase__InfluenzaA__ADK21746
MNPNQKIITIGSVCMTIGMANLILQIGNIISIWISHSIQLGNQNQIETCNQSIITYEHNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRSGFEMIWDPNGWTGTDNNFSIKQDIVGINEWSGYSGSFVQHPELTGLDCIRPCFWVELIRGRPEENTIWTSGSSISFCGVNSDTVGWSWPDGAELPFTIDK

SEQ ID NO: 19043 - protein, 469 aa, Artificial Sequence; identical to SEQ ID NO: 16738
  neuraminidase__InfluenzaA__ADK21756

SEQ ID NO: 19044 - protein, 469 aa, Artificial Sequence; identical to SEQ ID NO: 16738
  neuraminidase__InfluenzaA__ADK21766

SEQ ID NO: 19045 - protein, 469 aa, Artificial Sequence; identical to SEQ ID NO: 18169
  neuraminidase__InfluenzaA__ADK21776

SEQ ID NO: 19046 - protein, 469 aa, Artificial Sequence; identical to SEQ ID NO: 16738
  neuraminidase__InfluenzaA__ADK21786

SEQ ID NO: 19047 - protein, 469 aa, Artificial Sequence; identical to SEQ ID NO: 16738
  neuraminidase__InfluenzaA__ADK21796

SEQ ID NO: 19048 - protein, 469 aa, Artificial Sequence; identical to SEQ ID NO: 16738
  neuraminidase__InfluenzaA__ADK21806

SEQ ID NO: 19049 - protein, 469 aa, Artificial Sequence; identical to SEQ ID NO: 16738
  neuraminidase__InfluenzaA__ADK21816

SEQ ID NO: 19050 - protein, 469 aa, Artificial Sequence; identical to SEQ ID NO: 18716
  neuraminidase__InfluenzaA__ADK21826

SEQ ID NO: 19051 - protein, 469 aa, Artificial Sequence; identical to SEQ ID NO: 18629
  neuraminidase__InfluenzaA__ADK21836

SEQ ID NO: 19052 - protein, 469 aa, Artificial Sequence
  neuraminidase__InfluenzaA__ADK21846
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSMKQDIVGINEWSGYSGSFVQHPELTGLDCIRPCFWVELIRGRPKENTIWASGSSISFCGVNSDTVGWSWPDGAELPFTIDK

SEQ ID NO: 19053 - protein, 469 aa, Artificial Sequence; identical to SEQ ID NO: 16738
  neuraminidase__InfluenzaA__ADK21856

SEQ ID NO: 19054 - protein, 469 aa, Artificial Sequence; identical to SEQ ID NO: 16738
  neuraminidase__InfluenzaA__ADK21866

SEQ ID NO: 19055 - protein, 469 aa, Artificial Sequence; identical to SEQ ID NO: 16738
  neuraminidase__InfluenzaA__ADK21876

SEQ ID NO: 19056 - protein, 469 aa, Artificial Sequence; identical to SEQ ID NO: 16738
  neuraminidase__InfluenzaA__ADK21886

SEQ ID NO: 19057 - protein, 469 aa, Artificial Sequence
  neuraminidase__InfluenzaA__ADK21896
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGTNEWSGYSGSFVQHPELTGLDCIRPCFWVELIRGRPKENTIWTSGSSISFCGVSSDTVGWSWPDGAELPFTIDK

SEQ ID NO: 19058 - protein, 469 aa, Artificial Sequence
  neuraminidase__InfluenzaA__ADK21906
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWISFNQNLEYQIGYICSGIFGDNPRPNDKTGSCGPVSSNGANGVKGFSFKYGNGVWIGRTKSIGSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19059 - protein, 469 aa, Artificial Sequence; identical to SEQ ID NO: 16738
  neuraminidase__InfluenzaA__ADK21916

SEQ ID NO: 19060 - protein, 469 aa, Artificial Sequence; identical to SEQ ID NO: 16738
  neuraminidase__InfluenzaA__ADK21926

SEQ ID NO: 19061 - protein, 469 aa, Artificial Sequence; identical to SEQ ID NO: 16738
  neuraminidase__InfluenzaA__ADK21936

SEQ ID NO: 19062 - protein, 469 aa, Artificial Sequence
  neuraminidase__InfluenzaA__ADK21946
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGMDCIRPCFWVELIRGRPKENTIWTSGSSISFCGVNSDTVGWSWPDGAELPFTIDK

SEQ ID NO: 19063 - protein, 469 aa, Artificial Sequence
  neuraminidase__InfluenzaA__ADK21956
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSNTVGWSWPDGAELPFTIDK

SEQ ID NO: 19064 - protein, 469 aa, Artificial Sequence; identical to SEQ ID NO: 16738
  neuraminidase__InfluenzaA__ADK32393

SEQ ID NO: 19065 - protein, 469 aa, Artificial Sequence; identical to SEQ ID NO: 16738
  neuraminidase__InfluenzaA__ADK32403

SEQ ID NO: 19066 - protein, 469 aa, Artificial Sequence; identical to SEQ ID NO: 16738
  neuraminidase__InfluenzaA__ADK32413

SEQ ID NO: 19067 - protein, 469 aa, Artificial Sequence
  neuraminidase__InfluenzaA__ADK32423
MNPNQKIITIGSVCMTIGMTNLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19068 - protein, 469 aa, Artificial Sequence; identical to SEQ ID NO: 16738
  neuraminidase__InfluenzaA__ADK32433

SEQ ID NO: 19069 - protein, 469 aa, Artificial Sequence; identical to SEQ ID NO: 16738
  neuraminidase__InfluenzaA__ADK32443

SEQ ID NO: 19070 - protein, 469 aa, Artificial Sequence
  neuraminidase__InfluenzaA__ADK32453
MNPNQKIITIGSVCMTIGMANLILQIGNIISIWISHSIQLGNQNQIETCNQSVITYENNTWVNQTYVNISNTNFAAGQSVVSVKLSGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19071 - protein, 469 aa, Artificial Sequence
  neuraminidase__InfluenzaA__ADK32463
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALINDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19072 - protein, 469 aa, Artificial Sequence; identical to SEQ ID NO: 16738
  neuraminidase__InfluenzaA__ADK32473

SEQ ID NO: 19073 - protein, 469 aa, Artificial Sequence; identical to SEQ ID NO: 16738
  neuraminidase__InfluenzaA__ADK32483

SEQ ID NO: 19074 - protein, 469 aa, Artificial Sequence; identical to SEQ ID NO: 16738
  neuraminidase__InfluenzaA__ADK32493

SEQ ID NO: 19075 - protein, 469 aa, Artificial Sequence; identical to SEQ ID NO: 18651
  neuraminidase__InfluenzaA__ADK32505

SEQ ID NO: 19076 - protein, 469 aa, Artificial Sequence
  neuraminidase__InfluenzaA__ADK32640
MNPNQKIITIGSVCMTIGMANLILQIGNIISIWISHSIQLGNQNQIETCNQSVITYENNTWVNQTYVNISNTNFAAGQSVASVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19077 - protein, 469 aa, Artificial Sequence; identical to SEQ ID NO: 16738
  neuraminidase__InfluenzaA__ADK32650

SEQ ID NO: 19078 - protein, 469 aa, Artificial Sequence; identical to SEQ ID NO: 16738
  neuraminidase__InfluenzaA__ADK32660

SEQ ID NO: 19079 - protein, 469 aa, Artificial Sequence; identical to SEQ ID NO: 16738
  neuraminidase__InfluenzaA__ADK32670

SEQ ID NO: 19080 - protein, 469 aa, Artificial Sequence
  neuraminidase__InfluenzaA__ADK32680
MNPNQKIITIGSVCMTIGMANLILQIGNIISIWISHSIQLGNQNQIETCNQSVITYKNNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19081 - protein, 469 aa, Artificial Sequence; identical to SEQ ID NO: 16738
  neuraminidase__InfluenzaA__ADK32690

SEQ ID NO: 19082 - protein, 469 aa, Artificial Sequence; identical to SEQ ID NO: 16738
  neuraminidase__InfluenzaA__ADK32700

SEQ ID NO: 19083 - protein, 469 aa, Artificial Sequence; identical to SEQ ID NO: 16738
  neuraminidase__InfluenzaA__ADK32779

SEQ ID NO: 19084 - protein, 469 aa, Artificial Sequence; identical to SEQ ID NO: 16738
  neuraminidase__InfluenzaA__ADK33614

SEQ ID NO: 19085 - protein, 469 aa, Artificial Sequence; identical to SEQ ID NO: 16738
  neuraminidase__InfluenzaA__ADK33624

SEQ ID NO: 19086 - protein, 469 aa, Artificial Sequence; identical to SEQ ID NO: 16738
  neuraminidase__InfluenzaA__ADK33634

SEQ ID NO: 19087 - protein, 469 aa, Artificial Sequence
  neuraminidase__InfluenzaA__ADK33644
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGSDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19088 - protein, 469 aa, Artificial Sequence; identical to SEQ ID NO: 18469
  neuraminidase__InfluenzaA__ADK33654

SEQ ID NO: 19089 - protein, 469 aa, Artificial Sequence; identical to SEQ ID NO: 18469
  neuraminidase__InfluenzaA__ADK33664

SEQ ID NO: 19090 - protein, 469 aa, Artificial Sequence; identical to SEQ ID NO: 16738
  neuraminidase__InfluenzaA__ADK33674

SEQ ID NO: 19091 - protein, 469 aa, Artificial Sequence; identical to SEQ ID NO: 16738
  neuraminidase__InfluenzaA__ADK33684

SEQ ID NO: 19092 - protein, 469 aa, Artificial Sequence; identical to SEQ ID NO: 18089
  neuraminidase__InfluenzaA__ADK33694

SEQ ID NO: 19093 - protein, 469 aa, Artificial Sequence; identical to SEQ ID NO: 16738
  neuraminidase__InfluenzaA__ADK33704

SEQ ID NO: 19094 - protein, 469 aa, Artificial Sequence; identical to SEQ ID NO: 16738
  neuraminidase__InfluenzaA__ADK33714

SEQ ID NO: 19095 - protein, 469 aa, Artificial Sequence; identical to SEQ ID NO: 16738
  neuraminidase__InfluenzaA__ADK33744

SEQ ID NO: 19096 - protein, 469 aa, Artificial Sequence
  neuraminidase__InfluenzaA__ADK33754
MNPNQKIITIGSVCMTIGMANFILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19097 - protein, 469 aa, Artificial Sequence
  neuraminidase__InfluenzaA__ADK33764
MNPNQKIITIGSVCMTIGMANFILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQMGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19098 - protein, 469 aa, Artificial Sequence
  neuraminidase__InfluenzaA__ADK33774
MNPNQKIITIGSVCMTIGMANLILQIGNIISIWISHSIQLGNQNQIETCNQSVITYENNTWVNQTYVNISNTNFAAGQSVVSVKLVGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQMGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19099 - protein, 469 aa, Artificial Sequence; identical to SEQ ID NO: 17712
  neuraminidase__InfluenzaA__ADK33784

SEQ ID NO: 19100 - protein, 469 aa, Artificial Sequence; identical to SEQ ID NO: 16738
  neuraminidase__InfluenzaA__ADK33794

SEQ ID NO: 19101 - protein, 469 aa, Artificial Sequence; identical to SEQ ID NO: 16738
  neuraminidase__InfluenzaA__ADK33804

SEQ ID NO: 19102 - protein, 469 aa, Artificial Sequence
  neuraminidase__InfluenzaA__ADK33814
MNPNQKIITIGSVCMTIGMANLILQIGNIISIWISHSIQLGNQNQIETCNQSVITYENNTWVNKTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQMGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19103 - protein, 469 aa, Artificial Sequence
  neuraminidase__InfluenzaA__ADK33824
MNPNQKIITIGSVCMTIGMANLILQIGNIISIWISHSIQLGNQNQIETCNQSVITYENNTWVNQTYINISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19104 - protein, 469 aa, Artificial Sequence; identical to SEQ ID NO: 17915
  neuraminidase__InfluenzaA__ADK33834

SEQ ID NO: 19105 - protein, 469 aa, Artificial Sequence
  neuraminidase__InfluenzaA__ADK33844
MNPNQKIITIGSVCMTIGMANLILQIGNIISIWISHSIQLGNQNQIETCNQSVITYENNTWVNQTYVNISNTNFAAGQSVVSAKLAGNSPLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19106 - protein, 469 aa, Artificial Sequence; identical to SEQ ID NO: 17915
  neuraminidase__InfluenzaA__ADK33854

SEQ ID NO: 19107 - protein, 469 aa, Artificial Sequence; identical to SEQ ID NO: 18629
  neuraminidase__InfluenzaA__ADK33864

SEQ ID NO: 19108 - protein, 469 aa, Artificial Sequence
  neuraminidase__InfluenzaA__ADK33874
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYLCSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19109 - protein, 469 aa, Artificial Sequence; identical to SEQ ID NO: 16738
  neuraminidase__InfluenzaA__ADK33884

SEQ ID NO: 19110 - protein, 469 aa, Artificial Sequence; identical to SEQ ID NO: 17915
  neuraminidase__InfluenzaA__ADK33894

SEQ ID NO: 19111 - protein, 469 aa, Artificial Sequence; identical to SEQ ID NO: 17915
  neuraminidase__InfluenzaA__ADK33904

SEQ ID NO: 19112 - protein, 469 aa, Artificial Sequence; identical to SEQ ID NO: 18695
  neuraminidase__InfluenzaA__ADK33914

SEQ ID NO: 19113 - protein, 469 aa, Artificial Sequence
  neuraminidase__InfluenzaA__ADK33924
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSNTVGWSWPDGAELPFTIDK

SEQ ID NO: 19114 - protein, 469 aa, Artificial Sequence; identical to SEQ ID NO: 16738
  neuraminidase__InfluenzaA__ADK33934

SEQ ID NO: 19115 - protein, 469 aa, Artificial Sequence; identical to SEQ ID NO: 16738
  neuraminidase__InfluenzaA__ADK33944

SEQ ID NO: 19116 - protein, 469 aa, Artificial Sequence; identical to SEQ ID NO: 18695
  neuraminidase__InfluenzaA__ADK33954

SEQ ID NO: 19117 - protein, 469 aa, Artificial Sequence; identical to SEQ ID NO: 16738
  neuraminidase__InfluenzaA__ADK33964

SEQ ID NO: 19118 - protein, 469 aa, Artificial Sequence; identical to SEQ ID NO: 17845
  neuraminidase__InfluenzaA__ADK33974

SEQ ID NO: 19119 - protein, 469 aa, Artificial Sequence; identical to SEQ ID NO: 16738
  neuraminidase__InfluenzaA__ADK33984

SEQ ID NO: 19120 - protein, 469 aa, Artificial Sequence
  neuraminidase__InfluenzaA__ADK39016
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPDGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19121 - protein, 469 aa, Artificial Sequence; identical to SEQ ID NO: 16599
  neuraminidase__InfluenzaA__ADK45315

SEQ ID NO: 19122 - protein, 469 aa, Artificial Sequence
  neuraminidase__InfluenzaA__ADK45413
MNPNQKIITIGSVSLTISTICFFMQIAILITTVTLHFKQYEFNSPPNNQVMLYEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIASSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 19123 - protein, 469 aa, Artificial Sequence
  neuraminidase__InfluenzaA__ADK45424
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYLCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19124 - protein, 469 aa, Artificial Sequence; identical to SEQ ID NO: 17905
  neuraminidase__InfluenzaA__ADK45446

SEQ ID NO: 19125 - protein, 469 aa, Artificial Sequence
  neuraminidase__InfluenzaA__ADK45457
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSGSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19126 - protein, 469 aa, Artificial Sequence
  neuraminidase__InfluenzaA__ADK45479
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKVVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEEAEVLWTSNSIVVFCGTSGTYGTGSWPDGADLNLMPI

SEQ ID NO: 19127 - protein, 469 aa, Artificial Sequence; identical to SEQ ID NO: 16738
  neuraminidase__InfluenzaA__ADK48799

SEQ ID NO: 19128 - protein, 469 aa, Artificial Sequence; identical to SEQ ID NO: 18651
  neuraminidase__InfluenzaA__ADK62686

SEQ ID NO: 19129 - protein, 469 aa, Artificial Sequence; identical to SEQ ID NO: 18089
  neuraminidase__InfluenzaA__ADK62696

SEQ ID NO: 19130 - protein, 469 aa, Artificial Sequence; identical to SEQ ID NO: 17321
  neuraminidase__InfluenzaA__ADK64994

SEQ ID NO: 19131 - protein, 469 aa, Artificial Sequence
  neuraminidase__InfluenzaA__ADK65002
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRTGSKGDVFVIREPFISCSPLECRTFFLTQGALLNDKHSNGTIKDRSPYRTLMSCPIGEVPSPYNSRFESVAWSASACHDGINWLTIGISGPDNGAVAGLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19132 - protein, 469 aa, Artificial Sequence; identical to SEQ ID NO: 16738
  neuraminidase__InfluenzaA__ADK65010

SEQ ID NO: 19133 - protein, 469 aa, Artificial Sequence
  neuraminidase__InfluenzaA__ADK65018
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWPASACHDGINWLTIGISGPDNGAVAVLKYNGIITDTIKSWRNNILRTQESECACVNGSCFTIMTDGPSDGQASYKIFRIEKGKIVKSIEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19134 - protein, 469 aa, Artificial Sequence
  neuraminidase__InfluenzaA__ADK87290
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKAYTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 19135 - protein, 469 aa, Artificial Sequence
  neuraminidase__InfluenzaA__ADK87292
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYACSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 19136 - protein, 469 aa, Artificial Sequence
  neuraminidase__InfluenzaA__ADK87294
MNPNQKIIAIGSVSLTISTICFFLQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCRDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDTGKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNNIVVFCGTSGTYGTGSWPDGADINLMPV

SEQ ID NO: 19137 - protein, 469 aa, Artificial Sequence
  neuraminidase__InfluenzaA__ADK87297
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKNRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19138 - protein, 469 aa, Artificial Sequence
  neuraminidase__InfluenzaA__ADK87299
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASFKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19139 - protein, 469 aa, Artificial Sequence
  neuraminidase__InfluenzaA__ADK87301
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVAMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19140 - protein, 469 aa, Artificial Sequence; identical to SEQ ID NO: 16599
  neuraminidase__InfluenzaA__ADK87303

SEQ ID NO: 19141 - protein, 469 aa, Artificial Sequence
  neuraminidase__InfluenzaA__ADK87305
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVGRGNRSGYSGIFSVEGKSCINRCFYVELIRGRKEETEVLWTSNSIVVFCGTSGTYGTGSWPDGADINLMPV

SEQ ID NO: 19142 - protein, 469 aa, Artificial Sequence
  neuraminidase__InfluenzaA__ADK87307
MNPNQKVITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVGRGNRSGYSGIFSVEGKSCINRCFYVELIGGRKEETEVLWTSNSIVVFCGTSGTYGTGSWPDGADINLMPV

SEQ ID NO: 19143 - protein, 469 aa, Artificial Sequence
  neuraminidase__InfluenzaA__ADK87312
MNPNQTIITIGSVCMTIGMANLILQIGNIISIWISHSIQLGNQNQIETCNQSVITYENNTWVNQTYVNISNTNFAAGQSVISVKLAGNSSLCPVSGWAIYSKDNNIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19144 - protein, 469 aa, Artificial Sequence
  neuraminidase__InfluenzaA__ADK87314
MNPNQKIITIGSVSLTISTICFFMQIAILITTVTLHFKQYEFNSPPNNQVMLCEPTIIEGNITEIVYLTNTTIEKEMCPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTSSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 19145 - protein, 469 aa, Artificial Sequence
  neuraminidase__InfluenzaA__ADK87316
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPEITGLDCIRPCFWVELIRGRPKENTIWTSGSSISFCGVNSDTVGWSWPDGAELPFTIDK

SEQ ID NO: 19146 - protein, 469 aa, Artificial Sequence
  neuraminidase__InfluenzaA__ADK87318
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCSWVELIRGRPKENTIWTSGSSTSFCGVNSDTVGWSWPDGAELPFTIDK

SEQ ID NO: 19147 - protein, 469 aa, Artificial Sequence
  neuraminidase__InfluenzaA__ADK87320
MNPNQKIITIGSVCMTIGMANLILQIGNIISIWISHSIQLGNQNQIETCNQSVITYENNTWVHQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLNCIRPCFWVELIRGRPKENTIWTSGSSISFCGVNSDTVGWSWPDGAELPFTIDK

SEQ ID NO: 19148 - protein, 469 aa, Artificial Sequence
  neuraminidase__InfluenzaA__ADK87324
MNPNQKIITIGSVSLTISTICFLMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPGKCYQFALGQGTTLNNVHSNNTVRDRTPYRTLLMNELGVPFHLGTKQVCIAWSSSSCHDGKAWLHVCITGDDENATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 19149 - protein, 469 aa, Artificial Sequence
  neuraminidase__InfluenzaA__ADK87327
MNPNQKIMTIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISERSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 19150 - protein, 469 aa, Artificial Sequence; identical to SEQ ID NO: 16738
  neuraminidase__InfluenzaA__ADK87329

SEQ ID NO: 19151 - protein, 469 aa, Artificial Sequence
  neuraminidase__InfluenzaA__ADK87330
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWASGSSISFCGVNSDTVGWSWPDGAELPFTIDK

SEQ ID NO: 19152 - protein, 469 aa, Artificial Sequence; identical to SEQ ID NO: 16738
  neuraminidase__InfluenzaA__ADK87331

SEQ ID NO: 19153 - protein, 469 aa, Artificial Sequence
  neuraminidase__InfluenzaA__ADK87332
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKHNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19154 - protein, 469 aa, Artificial Sequence
  neuraminidase__InfluenzaA__ADK87333
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPYSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19155 - protein, 469 aa, Artificial Sequence
  neuraminidase__InfluenzaA__ADK87335
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDRRYQFALGQGTTLNNVHSDNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGNAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19156 - protein, 469 aa, Artificial Sequence
  neuraminidase__InfluenzaA__ADK87337
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNAVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGNAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19157 - protein, 469 aa, Artificial Sequence
  neuraminidase__InfluenzaA__ADK87339
MNPNQKIITIGSICMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19158 - protein, 469 aa, Artificial Sequence; identical to SEQ ID NO: 16738
  neuraminidase__InfluenzaA__ADK90209

SEQ ID NO: 19159 - protein, 469 aa, Artificial Sequence; identical to SEQ ID NO: 16738
  neuraminidase__InfluenzaA__ADK90213

SEQ ID NO: 19160 - protein, 469 aa, Artificial Sequence; identical to SEQ ID NO: 16738
  neuraminidase__InfluenzaA__ADK90217

SEQ ID NO: 19161 - protein, 469 aa, Artificial Sequence; identical to SEQ ID NO: 18717
  neuraminidase__InfluenzaA__ADK90221

SEQ ID NO: 19162 - protein, 469 aa, Artificial Sequence; identical to SEQ ID NO: 18717
  neuraminidase__InfluenzaA__ADK90225

SEQ ID NO: 19163 - protein, 469 aa, Artificial Sequence; identical to SEQ ID NO: 16738
  neuraminidase__InfluenzaA__ADK90229

SEQ ID NO: 19164 - protein, 469 aa, Artificial Sequence; identical to SEQ ID NO: 16738
  neuraminidase__InfluenzaA__ADK90233

SEQ ID NO: 19165 - protein, 469 aa, Artificial Sequence
  neuraminidase__InfluenzaA__ADK90241
MNPNQKIITIGSVCMTIGMANLILQIGNIISIWISHSIQLGNQNQIETCNQSVITYENNTWVNQTYVNISNANFAAGQSVVSVKLAGNSSLCPVSGWAIYSKDNSIRIGSKGDVFVIREPFISCSPLECRTFFLTQGALLNDKHSNGTIKDRSPHRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19166 - protein, 469 aa, Artificial Sequence; identical to SEQ ID NO: 18717
  neuraminidase__InfluenzaA__ADK90245

SEQ ID NO: 19167 - protein, 469 aa, Artificial Sequence
  neuraminidase__InfluenzaA__ADK90249
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSMKQDIVGINEWSGYSGSFVQHPELTGLDCIRPCFWVELIRGRPKENTIWTSGSSISFCGVNSDTVGWSWPDGAELPFTIDK

SEQ ID NO: 19168 - protein, 469 aa, Artificial Sequence; identical to SEQ ID NO: 19167
  neuraminidase__InfluenzaA__ADK90253

SEQ ID NO: 19169 - protein, 469 aa, Artificial Sequence
  neuraminidase__InfluenzaA__ADK90257
MNPNQKIIIIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPHRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19170 - protein, 469 aa, Artificial Sequence; identical to SEQ ID NO: 17092
  neuraminidase__InfluenzaA__ADK90261

SEQ ID NO: 19171 - protein, 469 aa, Artificial Sequence
  neuraminidase__InfluenzaA__ADK90265
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQMGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19172 - protein, 469 aa, Artificial Sequence
  neuraminidase__InfluenzaA__ADK90269
MNPNQKIITIGSVCMTIGMANLILQIGNIISIWISHSIQLGNQNQIEKCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSIEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSIISFCGVNSDTVGWSWPDGAELPFTIDK

SEQ ID NO: 19173 - protein, 469 aa, Artificial Sequence; identical to SEQ ID NO: 16738
  neuraminidase__InfluenzaA__ADK90273

SEQ ID NO: 19174 - protein, 469 aa, Artificial Sequence; identical to SEQ ID NO: 16738
  neuraminidase__InfluenzaA__ADK90277

SEQ ID NO: 19175 - protein, 469 aa, Artificial Sequence; identical to SEQ ID NO: 16738
  neuraminidase__InfluenzaA__ADK90281

SEQ ID NO: 19176 - protein, 469 aa, Artificial Sequence
  neuraminidase__InfluenzaA__ADK90289
MNPNQKIITIGSVCMTIGMANLILQIGNIISIWISHSIQLGNQNLIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19177 - protein, 469 aa, Artificial Sequence; identical to SEQ ID NO: 18717
  neuraminidase__InfluenzaA__ADK90293

SEQ ID NO: 19178 - protein, 469 aa, Artificial Sequence; identical to SEQ ID NO: 18629
  neuraminidase__InfluenzaA__ADK90297

SEQ ID NO: 19179 - protein, 469 aa, Artificial Sequence; identical to SEQ ID NO: 16738
  neuraminidase__InfluenzaA__ADK90301

SEQ ID NO: 19180 - protein, 469 aa, Artificial Sequence; identical to SEQ ID NO: 18629
  neuraminidase__InfluenzaA__ADK90305

SEQ ID NO: 19181 - protein, 469 aa, Artificial Sequence; identical to SEQ ID NO: 16738
  neuraminidase__InfluenzaA__ADK90309

SEQ ID NO: 19182 - protein, 469 aa, Artificial Sequence
  neuraminidase__InfluenzaA__ADK90313
MNPNHKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPHRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19183 - protein, 469 aa, Artificial Sequence; identical to SEQ ID NO: 16738
  neuraminidase__InfluenzaA__ADK90317

SEQ ID NO: 19184 - protein, 469 aa, Artificial Sequence; identical to SEQ ID NO: 18717
  neuraminidase__InfluenzaA__ADK90321

SEQ ID NO: 19185 - protein, 469 aa, Artificial Sequence; identical to SEQ ID NO: 16738
  neuraminidase__InfluenzaA__ADK90325

SEQ ID NO: 19186 - protein, 469 aa, Artificial Sequence
  neuraminidase__InfluenzaA__ADK90329
MNPNQKIITIGSVCMTIGMANLILQIGNIISIWISHSIQLGNQNQIETCNRSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNEAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19187 - protein, 469 aa, Artificial Sequence
  neuraminidase__InfluenzaA__ADK90333
MNPNQKIITIGSVCMTIGMANLILQIGNIISIWISHSIQLGNKNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19188 - protein, 469 aa, Artificial Sequence; identical to SEQ ID NO: 18717
  neuraminidase__InfluenzaA__ADK90337

SEQ ID NO: 19189 - protein, 469 aa, Artificial Sequence; identical to SEQ ID NO: 17797
  neuraminidase__InfluenzaA__ADK90341

SEQ ID NO: 19190 - protein, 469 aa, Artificial Sequence; identical to SEQ ID NO: 17797
  neuraminidase__InfluenzaA__ADK90345

SEQ ID NO: 19191 - protein, 469 aa, Artificial Sequence; identical to SEQ ID NO: 17797
  neuraminidase__InfluenzaA__ADK90349

SEQ ID NO: 19192 - protein, 469 aa, Artificial Sequence; identical to SEQ ID NO: 18717
  neuraminidase__InfluenzaA__ADK90353

SEQ ID NO: 19193 - protein, 469 aa, Artificial Sequence; identical to SEQ ID NO: 16738
  neuraminidase__InfluenzaA__ADK90357

SEQ ID NO: 19194 - protein, 469 aa, Artificial Sequence; identical to SEQ ID NO: 18717
  neuraminidase__InfluenzaA__ADK90361

SEQ ID NO: 19195 - protein, 469 aa, Artificial Sequence; identical to SEQ ID NO: 17712
  neuraminidase__InfluenzaA__ADK90365

SEQ ID NO: 19196 - protein, 469 aa, Artificial Sequence; identical to SEQ ID NO: 16738
  neuraminidase__InfluenzaA__ADK90369

SEQ ID NO: 19197 - protein, 469 aa, Artificial Sequence; identical to SEQ ID NO: 16738
  neuraminidase__InfluenzaA__ADK90373

SEQ ID NO: 19198 - protein, 469 aa, Artificial Sequence
  neuraminidase__InfluenzaA__ADK90377
MNPNQKIITIGSVCMTIGMTNLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPHRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMDAPNYHYEECSCYPDSSEIICVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19199 - protein, 469 aa, Artificial Sequence; identical to SEQ ID NO: 18717
  neuraminidase__InfluenzaA__ADK90381

SEQ ID NO: 19200 - protein, 469 aa, Artificial Sequence
  neuraminidase__InfluenzaA__ADK90385
MNPNQKIITIGSVCMTIGMANLILQIGNIISIWISHSIQLGNQNQIETCNQSVITYENNTWVNQTYVNISNTNFAAGQSVVSVKLSGNSSLCPVSGWAIYSKDNSIRIGSKGDVFVIREPFISCSPLECRTFFLTQGALLNDKHSNGTIKDRSPHRTLMSCPIGEVPSPYNSRFESVAWSASACHDGINWLTIGISGPDNGAVAVLKYNGIITDTIKSWRNNILRTQESECTCVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19201 - protein, 469 aa, Artificial Sequence; identical to SEQ ID NO: 16738
  neuraminidase__InfluenzaA__ADK90389

SEQ ID NO: 19202 - protein, 469 aa, Artificial Sequence; identical to SEQ ID NO: 18717
  neuraminidase__InfluenzaA__ADK90393

SEQ ID NO: 19203 - protein, 469 aa, Artificial Sequence; identical to SEQ ID NO: 18629
  neuraminidase__InfluenzaA__ADK90397

SEQ ID NO: 19204 - protein, 469 aa, Artificial Sequence; identical to SEQ ID NO: 16738
  neuraminidase__InfluenzaA__ADK90401

SEQ ID NO: 19205 - protein, 469 aa, Artificial Sequence
  neuraminidase__InfluenzaA__ADK90405
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPHRTLMSCPIGEVPSPYNSRFESVAWSASACHDGINWLTIGISGPDNGAVAVLKYNGIITDTIKSWRNNILRTQESECTCVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19206 - protein, 469 aa, Artificial Sequence; identical to SEQ ID NO: 16738
  neuraminidase__InfluenzaA__ADK90409

SEQ ID NO: 19207 - protein, 469 aa, Artificial Sequence
  neuraminidase__InfluenzaA__ADK90413
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPHRTLMSCPIGEVPSPYNSRFESVAWSASACHDGINWLTIGISGPDNGAMAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19208 - protein, 469 aa, Artificial Sequence; identical to SEQ ID NO: 16738
  neuraminidase__InfluenzaA__ADK90417

SEQ ID NO: 19209 - protein, 469 aa, Artificial Sequence; identical to SEQ ID NO: 16738
  neuraminidase__InfluenzaA__ADK90421

SEQ ID NO: 19210 - protein, 469 aa, Artificial Sequence; identical to SEQ ID NO: 16738
  neuraminidase__InfluenzaA__ADK90425

SEQ ID NO: 19211 - protein, 469 aa, Artificial Sequence; identical to SEQ ID NO: 16738
  neuraminidase__InfluenzaA__ADK90429

SEQ ID NO: 19212 - protein, 469 aa, Artificial Sequence; identical to SEQ ID NO: 16599
  neuraminidase__InfluenzaA__ADK94194

SEQ ID NO: 19213 - protein, 469 aa, Artificial Sequence; identical to SEQ ID NO: 16599
  neuraminidase__InfluenzaA__ADK94205

SEQ ID NO: 19214 - protein, 469 aa, Artificial Sequence; identical to SEQ ID NO: 17905
  neuraminidase__InfluenzaA__ADK94216

SEQ ID NO: 19215 - protein, 469 aa, Artificial Sequence; identical to SEQ ID NO: 16599
  neuraminidase__InfluenzaA__ADK94227

SEQ ID NO: 19216 - protein, 469 aa, Artificial Sequence; identical to SEQ ID NO: 16599
  neuraminidase__InfluenzaA__ADK94238

SEQ ID NO: 19217 - protein, 469 aa, Artificial Sequence; identical to SEQ ID NO: 19123
  neuraminidase__InfluenzaA__ADK94260

SEQ ID NO: 19218 - protein, 469 aa, Artificial Sequence; identical to SEQ ID NO: 19123
  neuraminidase__InfluenzaA__ADK94271

SEQ ID NO: 19219 - protein, 469 aa, Artificial Sequence; identical to SEQ ID NO: 16599
  neuraminidase__InfluenzaA__ADK94293

SEQ ID NO: 19220 - protein, 469 aa, Artificial Sequence; identical to SEQ ID NO: 16599
  neuraminidase__InfluenzaA__ADK94304

SEQ ID NO: 19221 - protein, 469 aa, Artificial Sequence
  neuraminidase__InfluenzaA__ADK94326
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNIHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19222 - protein, 469 aa, Artificial Sequence; identical to SEQ ID NO: 17905
  neuraminidase__InfluenzaA__ADK94337

SEQ ID NO: 19223 - protein, 469 aa, Artificial Sequence; identical to SEQ ID NO: 16599
  neuraminidase__InfluenzaA__ADK94444

SEQ ID NO: 19224 - protein, 469 aa, Artificial Sequence
  neuraminidase__InfluenzaA__ADK94479
MNPNQKIITIGSVSLTISTICFLMQIAILTTTVTLHFKQYEFNSPPNNQVMLCEPTTIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYLCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETGVLWTSNSIVVFCGTSGTYGTGSWPDGADINLMPI

SEQ ID NO: 19225 - protein, 469 aa, Artificial Sequence; identical to SEQ ID NO: 16599
  neuraminidase__InfluenzaA__ADK94490

SEQ ID NO: 19226 - protein, 469 aa, Artificial Sequence; identical to SEQ ID NO: 16599
  neuraminidase__InfluenzaA__ADK94501

SEQ ID NO: 19227 - protein, 469 aa, Artificial Sequence
  neuraminidase__InfluenzaA__ADK94512
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGRIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19228 - protein, 469 aa, Artificial Sequence; identical to SEQ ID NO: 16599
  neuraminidase__InfluenzaA__ADK94534

SEQ ID NO: 19229 - protein, 469 aa, Artificial Sequence; identical to SEQ ID NO: 19123
  neuraminidase__InfluenzaA__ADK94556

SEQ ID NO: 19230 - protein, 469 aa, Artificial Sequence; identical to SEQ ID NO: 16599
  neuraminidase__InfluenzaA__ADK94567

SEQ ID NO: 19231 - protein, 469 aa, Artificial Sequence; identical to SEQ ID NO: 16599
  neuraminidase__InfluenzaA__ADK94578

SEQ ID NO: 19232 - protein, 469 aa, Artificial Sequence; identical to SEQ ID NO: 16599
  neuraminidase__InfluenzaA__ADK94589

SEQ ID NO: 19233 - protein, 469 aa, Artificial Sequence; identical to SEQ ID NO: 18289
  neuraminidase__InfluenzaA__ADK98504

SEQ ID NO: 19234 - protein, 469 aa, Artificial Sequence
  neuraminidase__InfluenzaA__ADK98506
MNPNQKIITIGSVCMTIGMANLILQIGNIISIWISHSIQLGNQNQIETCNQNVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19235 - protein, 469 aa, Artificial Sequence
  neuraminidase__InfluenzaA__ADK98626
MNPNQKIITIGSVSLTISTICFFMQIAILITTVTLHFKQYEFNSPPNNQVMLCEPTMIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYLCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19236 - protein, 469 aa, Artificial Sequence; identical to SEQ ID NO: 17905
  neuraminidase__InfluenzaA__ADK98637

SEQ ID NO: 19237 - protein, 469 aa, Artificial Sequence
  neuraminidase__InfluenzaA__ADK98648
MNPNQKIITIGSVSLTISTICFFMQIAILVTTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGRGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 19238 - protein, 469 aa, Artificial Sequence
  neuraminidase__InfluenzaA__ADK98659
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 19239 - protein, 469 aa, Artificial Sequence; identical to SEQ ID NO: 19123
  neuraminidase__InfluenzaA__ADK98670

SEQ ID NO: 19240 - protein, 469 aa, Artificial Sequence
  neuraminidase__InfluenzaA__ADK98681
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQTNRQVIVDRGNRSGYSGIFSVEGKNCINRCFYVELIRGRKEETEVLWTSNSIVVFCGTSGTYGTGSWPDGADINLMPI

SEQ ID NO: 19241 - protein, 469 aa, Artificial Sequence
  neuraminidase__InfluenzaA__ADK98703
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQTNRQVIVDRGNRSGYSGIFSVEGKNCINRCFYVELIRGRKEETEVLWTSNSIVVFCGTSGTYGTGSWPDGADINLMPI

SEQ ID NO: 19242 - protein, 469 aa, Artificial Sequence; identical to SEQ ID NO: 18484
  neuraminidase__InfluenzaA__ADK98725

SEQ ID NO: 19243 - protein, 469 aa, Artificial Sequence; identical to SEQ ID NO: 19123
  neuraminidase__InfluenzaA__ADK98736

SEQ ID NO: 19244 - protein, 469 aa, Artificial Sequence
  neuraminidase__InfluenzaA__ADK98747
MNPNQKIITIGSVSLTISTICFFMQIAILVTTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 19245 - protein, 469 aa, Artificial Sequence
  neuraminidase__InfluenzaA__ADK98758
MNPNQKIITIGSVSLTISTICFFMQIAILVTTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKANTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 19246 - protein, 469 aa, Artificial Sequence; identical to SEQ ID NO: 18484
  neuraminidase__InfluenzaA__ADK98769

SEQ ID NO: 19247 - protein, 469 aa, Artificial Sequence; identical to SEQ ID NO: 19038
  neuraminidase__InfluenzaA__ADK98780

SEQ ID NO: 19248 - protein, 469 aa, Artificial Sequence; identical to SEQ ID NO: 18484
  neuraminidase__InfluenzaA__ADK98791

SEQ ID NO: 19249 - protein, 469 aa, Artificial Sequence; identical to SEQ ID NO: 16599
  neuraminidase__InfluenzaA__ADK98802

SEQ ID NO: 19250 - protein, 469 aa, Artificial Sequence
  neuraminidase__InfluenzaA__ADK98813
MNPNQKIITIGSVSLTISTICFFMQIAILITTVTLHFKQYEFNSPPNNQVMLCEPAIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 19251 - protein, 469 aa, Artificial Sequence; identical to SEQ ID NO: 16599
  neuraminidase__InfluenzaA__ADK98824

SEQ ID NO: 19252 - protein, 469 aa, Artificial Sequence; identical to SEQ ID NO: 18484
  neuraminidase__InfluenzaA__ADK98835

SEQ ID NO: 19253 - protein, 469 aa, Artificial Sequence; identical to SEQ ID NO: 19123
  neuraminidase__InfluenzaA__ADK98846

SEQ ID NO: 19254 - protein, 469 aa, Artificial Sequence
  neuraminidase__InfluenzaA__ADK98857
MNPNQKIITIGSVSLTISTICFFMQIAILVTTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGANINLMPI

SEQ ID NO: 19255 - protein, 469 aa, Artificial Sequence
  neuraminidase__InfluenzaA__ADK98868
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEENEVLWTSNSIVVFCGTSGTYGTGSWPDGADINLMPI

SEQ ID NO: 19256 - protein, 469 aa, Artificial Sequence
  neuraminidase__InfluenzaA__ADK98879
MNPNQKIITIGSVSLTISTICFFMQIAILITTVTLHFKQYEFNSPPNNQAMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19257 - protein, 469 aa, Artificial Sequence; identical to SEQ ID NO: 19123
  neuraminidase__InfluenzaA__ADK98890

SEQ ID NO: 19258 - protein, 469 aa, Artificial Sequence; identical to SEQ ID NO: 18484
  neuraminidase__InfluenzaA__ADK98901

SEQ ID NO: 19259 - protein, 469 aa, Artificial Sequence; identical to SEQ ID NO: 19038
  neuraminidase__InfluenzaA__ADK98912

SEQ ID NO: 19260 - protein, 469 aa, Artificial Sequence; identical to SEQ ID NO: 19123
  neuraminidase__InfluenzaA__ADK98923

SEQ ID NO: 19261 - protein, 469 aa, Artificial Sequence; identical to SEQ ID NO: 17905
  neuraminidase__InfluenzaA__ADK98945

SEQ ID NO: 19262 - protein, 469 aa, Artificial Sequence
  neuraminidase__InfluenzaA__ADK98956
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSVVSSYVCSGLVGDTPRKSDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 19263 - protein, 469 aa, Artificial Sequence; identical to SEQ ID NO: 18484
  neuraminidase__InfluenzaA__ADK98967

SEQ ID NO: 19264 - protein, 469 aa, Artificial Sequence; identical to SEQ ID NO: 19123
  neuraminidase__InfluenzaA__ADK98978

SEQ ID NO: 19265 - protein, 469 aa, Artificial Sequence; identical to SEQ ID NO: 19262
  neuraminidase__InfluenzaA__ADK98989

SEQ ID NO: 19266 - protein, 469 aa, Artificial Sequence; identical to SEQ ID NO: 16599
  neuraminidase__InfluenzaA__ADK99000

SEQ ID NO: 19267 - protein, 469 aa, Artificial Sequence; identical to SEQ ID NO: 19262
  neuraminidase__InfluenzaA__ADK99011

SEQ ID NO: 19268 - protein, 469 aa, Artificial Sequence
  neuraminidase__InfluenzaA__ADK99022
MNPNQKIITIGSVSLTISTICFFMQIAILVTTVTLHFKQYEFNSPPNNQVMLCDPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 19269 - protein, 469 aa, Artificial Sequence; identical to SEQ ID NO: 16599
  neuraminidase__InfluenzaA__ADK99033

SEQ ID NO: 19270 - protein, 469 aa, Artificial Sequence
  neuraminidase__InfluenzaA__ADK99044
MNPNQKIITIGSVSLTISTICFFMQIAILITTVTLHFKQYEFNSPPNNQVMLCEPTIIERNKTEIVYLTNTTIEKEICPKLAEYRNWSKPQCDITGFAPFSKDNSIRLSAGGDIWVTREPYVSCDPDKCYQFALGQGTTLNNGHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 19271 - protein, 469 aa, Artificial Sequence
  neuraminidase__InfluenzaA__ADK99055
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19272 - protein, 469 aa, Artificial Sequence
  neuraminidase__InfluenzaA__ADK99066
MNPNQKIITIGSVSLTISTICFFMQIAILITTVTLHFKQCEFNSPPNNQVMLCEPTIIERNITEIVYLTNTTIEKKICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYLCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 19273 - protein, 469 aa, Artificial Sequence
  neuraminidase__InfluenzaA__ADK99077
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKVVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 19274 - protein, 469 aa, Artificial Sequence; identical to SEQ ID NO: 19038
  neuraminidase__InfluenzaA__ADK99088

SEQ ID NO: 19275 - protein, 469 aa, Artificial Sequence; identical to SEQ ID NO: 18484
  neuraminidase__InfluenzaA__ADK99099

SEQ ID NO: 19276 - protein, 469 aa, Artificial Sequence
  neuraminidase__InfluenzaA__ADK99110
MNPNQKIITIGSVSLTISTICFFMQIAILVTTVTLHFKQYEFNPPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 19277 - protein, 469 aa, Artificial Sequence; identical to SEQ ID NO: 19123
  neuraminidase__InfluenzaA__ADK99121

SEQ ID NO: 19278 - protein, 469 aa, Artificial Sequence
  neuraminidase__InfluenzaA__ADK99132
MNPNQKIITIGSVSLTISTICFFMQIAILITTVTLHFKQYEFNSPPNNQVMLCEPTIIERNITEIVYLTNTTVEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYLCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19279 - protein, 469 aa, Artificial Sequence; identical to SEQ ID NO: 19123
  neuraminidase__InfluenzaA__ADK99143

SEQ ID NO: 19280 - protein, 469 aa, Artificial Sequence; identical to SEQ ID NO: 16599
  neuraminidase__InfluenzaA__ADK99154

SEQ ID NO: 19281 - protein, 469 aa, Artificial Sequence
  neuraminidase__InfluenzaA__ADK99176
MNPNQKIITIGSVSLTISTICFFMQIAILVTTVTLHFKQYEFNSPPNNQVMLCEPTIIERNITEIVYLTNTTIEKEICLKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 19282 - protein, 469 aa, Artificial Sequence; identical to SEQ ID NO: 19273
  neuraminidase__InfluenzaA__ADK99187

SEQ ID NO: 19283 - protein, 469 aa, Artificial Sequence; identical to SEQ ID NO: 18484
  neuraminidase__InfluenzaA__ADK99198

SEQ ID NO: 19284 - protein, 469 aa, Artificial Sequence; identical to SEQ ID NO: 19123
  neuraminidase__InfluenzaA__ADK99220

SEQ ID NO: 19285 - protein, 469 aa, Artificial Sequence
  neuraminidase__InfluenzaA__ADK99231
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDNCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYLCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19286 - protein, 469 aa, Artificial Sequence
  neuraminidase__InfluenzaA__ADK99242
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIIVFCGTSGTYGTGSWPDGADINLMPI

SEQ ID NO: 19287 - protein, 469 aa, Artificial Sequence
  neuraminidase__InfluenzaA__ADK99253
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGHRSGYSGIFSVEGKSCINRCFYVELIRGRKEETEVLWTSNSIVVFCGTSGTYGTGSWPDGADLTLMPI

SEQ ID NO: 19288 - protein, 469 aa, Artificial Sequence
  neuraminidase__InfluenzaA__ADK99264
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYLCSGLVGDTPRKNDSSSSSHCLDPNNEEGGHGVKGWAFDDGNDVWMGRTISEKSRLGYETFKVIEGWSNPKSKLHINRQVIVDRGNRSGYSGIFSVEGKSCINRCFYVELIRGRKEETEVLWTSNSIVVFCGTSGTYGTGSWPDGADINLMPI

SEQ ID NO: 19289 - protein, 469 aa, Artificial Sequence
  neuraminidase__InfluenzaA__ADK99275
MNPNQKIITIGSVSLTISTICFFMQIAVLITTVTLHFKQYEFNSPPNNQVMLCEPTIIERNITEIVYLTNTTIEKEICPKLAGYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 19290 - protein, 469 aa, Artificial Sequence
  neuraminidase__InfluenzaA__ADK99286
MNPNQKIITIGSVSLTISTICFFMQIAILITTVTLHFKQYEFNPPPNNQVTPREPTIIERNITEIVYLTNTTIEKEICPKLAEYRNWSKPQCDITGFAPFSKDNSIRLSAGGDIWVTREPYVSCDPDKCYQFALGQGTTLNNIHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19291 - protein, 469 aa, Artificial Sequence; identical to SEQ ID NO: 17592
  neuraminidase__InfluenzaA__ADK99297

SEQ ID NO: 19292 - protein, 469 aa, Artificial Sequence
  neuraminidase__InfluenzaA__ADK99308
MNPNQKIITIGSVSLTISTICFFMQIAILVTTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGIPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 19293 - protein, 470 aa, Artificial Sequence; identical to SEQ ID NO: 17461
  neuraminidase__InfluenzaA__ADL14590

SEQ ID NO: 19294 - protein, 469 aa, Artificial Sequence; identical to SEQ ID NO: 18484
  neuraminidase__InfluenzaA__ADL27992

SEQ ID NO: 19295 - protein, 469 aa, Artificial Sequence; identical to SEQ ID NO: 19123
  neuraminidase__InfluenzaA__ADL28003

SEQ ID NO: 19296 - protein, 469 aa, Artificial Sequence; identical to SEQ ID NO: 19268
  neuraminidase__InfluenzaA__ADL28014

SEQ ID NO: 19297 - protein, 469 aa, Artificial Sequence
  neuraminidase__InfluenzaA__ADL28025
MNPNQKIITIGSVSLTISTICFFMQIAILITTVTLHFKQYEFNSPPNNQVMLCEPTIIERNITEIVYLTNTTIEKKICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYLCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19298 - protein, 469 aa, Artificial Sequence; identical to SEQ ID NO: 18484
  neuraminidase__InfluenzaA__ADL28036

SEQ ID NO: 19299 - protein, 469 aa, Artificial Sequence; identical to SEQ ID NO: 16599
  neuraminidase__InfluenzaA__ADL28047

SEQ ID NO: 19300 - protein, 469 aa, Artificial Sequence; identical to SEQ ID NO: 17905
  neuraminidase__InfluenzaA__ADL28058

SEQ ID NO: 19301 - protein, 469 aa, Artificial Sequence; identical to SEQ ID NO: 19276
  neuraminidase__InfluenzaA__ADL28069

SEQ ID NO: 19302 - protein, 469 aa, Artificial Sequence; identical to SEQ ID NO: 19123
  neuraminidase__InfluenzaA__ADL28080

SEQ ID NO: 19303 - protein, 469 aa, Artificial Sequence; identical to SEQ ID NO: 18484
  neuraminidase__InfluenzaA__ADL28091

SEQ ID NO: 19304 - protein, 469 aa, Artificial Sequence
  neuraminidase__InfluenzaA__ADL28102
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19305 - protein, 469 aa, Artificial Sequence; identical to SEQ ID NO: 16599
  neuraminidase__InfluenzaA__ADL28113

SEQ ID NO: 19306 - protein, 469 aa, Artificial Sequence
  neuraminidase__InfluenzaA__ADL28129
MNPNQKIITIGSVSLTISTICFFMQIAILVTTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEILWTSNSIVVFCGTSGTYGTGSWPDGANINLMPI

SEQ ID NO: 19307 - protein, 469 aa, Artificial Sequence
  neuraminidase__InfluenzaA__ADL28140
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGANINLMPI

SEQ ID NO: 19308 - protein, 469 aa, Artificial Sequence; identical to SEQ ID NO: 18484
  neuraminidase__InfluenzaA__ADL28151

SEQ ID NO: 19309 - protein, 469 aa, Artificial Sequence; identical to SEQ ID NO: 17905
  neuraminidase__InfluenzaA__ADL28162

SEQ ID NO: 19310 - protein, 469 aa, Artificial Sequence; identical to SEQ ID NO: 19123
  neuraminidase__InfluenzaA__ADL28173

SEQ ID NO: 19311 - protein, 469 aa, Artificial Sequence; identical to SEQ ID NO: 18484
  neuraminidase__InfluenzaA__ADL28184

SEQ ID NO: 19312 - protein, 469 aa, Artificial Sequence
  neuraminidase__InfluenzaA__ADL28195
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCVNGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19313 - protein, 469 aa, Artificial Sequence; identical to SEQ ID NO: 19273
  neuraminidase__InfluenzaA__ADL28206

SEQ ID NO: 19314 - protein, 469 aa, Artificial Sequence; identical to SEQ ID NO: 17592
  neuraminidase__InfluenzaA__ADL28217

SEQ ID NO: 19315 - protein, 469 aa, Artificial Sequence; identical to SEQ ID NO: 18484
  neuraminidase__InfluenzaA__ADL28228

SEQ ID NO: 19316 - protein, 469 aa, Artificial Sequence; identical to SEQ ID NO: 19123
  neuraminidase__InfluenzaA__ADL28239

SEQ ID NO: 19317 - protein, 469 aa, Artificial Sequence; identical to SEQ ID NO: 17905
  neuraminidase__InfluenzaA__ADL28250

SEQ ID NO: 19318 - protein, 469 aa, Artificial Sequence; identical to SEQ ID NO: 19123
  neuraminidase__InfluenzaA__ADL28261

SEQ ID NO: 19319 - protein, 469 aa, Artificial Sequence; identical to SEQ ID NO: 18484
  neuraminidase__InfluenzaA__ADL28373

SEQ ID NO: 19320 - protein, 469 aa, Artificial Sequence; identical to SEQ ID NO: 16603
  neuraminidase__InfluenzaA__ADL28387

SEQ ID NO: 19321 - protein, 469 aa, Artificial Sequence
  neuraminidase__InfluenzaA__ADL28391
MNPNQKIITIGSVSLTISTICFFMQIAILITTVTLHFKQYEFNSSPNNQVMLCEPTIIERNITEIVYLTNTTIEKEICPKLAEYRNWSKPQCDITGFAPFSKDNSIRLSAGGDIWVTRVPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19322 - protein, 469 aa, Artificial Sequence
  neuraminidase__InfluenzaA__ADL28395
MNPNQKIITIGSVSLTIATICFLMQIAILVTTVTLHFKQYECNSPPNNQVMLCEPAIIERNITEIVYLTNTTIEKEICPKLAEYRNWSKPQCNITGFAPFSKDNSIRLSAGGDIWVTRVPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVNISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKFRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 19323 - protein, 469 aa, Artificial Sequence; identical to SEQ ID NO: 16738
  neuraminidase__InfluenzaA__ADL29675

SEQ ID NO: 19324 - protein, 469 aa, Artificial Sequence; identical to SEQ ID NO: 16738
  neuraminidase__InfluenzaA__ADL29685

SEQ ID NO: 19325 - protein, 469 aa, Artificial Sequence
  neuraminidase__InfluenzaA__ADL29695
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDIVGWSWPDGAELPFTIDK

SEQ ID NO: 19326 - protein, 469 aa, Artificial Sequence; identical to SEQ ID NO: 16738
  neuraminidase__InfluenzaA__ADL29705

SEQ ID NO: 19327 - protein, 469 aa, Artificial Sequence; identical to SEQ ID NO: 19325
  neuraminidase__InfluenzaA__ADL29733

SEQ ID NO: 19328 - protein, 469 aa, Artificial Sequence; identical to SEQ ID NO: 16738
  neuraminidase__InfluenzaA__ADL29743

SEQ ID NO: 19329 - protein, 469 aa, Artificial Sequence
  neuraminidase__InfluenzaA__ADL29753
MNPNQKIITIGSVCMAIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDIVGWSWPDGAELPFTIDK

SEQ ID NO: 19330 - protein, 469 aa, Artificial Sequence; identical to SEQ ID NO: 16738
  neuraminidase__InfluenzaA__ADL29763

SEQ ID NO: 19331 - protein, 469 aa, Artificial Sequence; identical to SEQ ID NO: 19325
  neuraminidase__InfluenzaA__ADL29773

SEQ ID NO: 19332 - protein, 469 aa, Artificial Sequence; identical to SEQ ID NO: 16738
  neuraminidase__InfluenzaA__ADL29783

SEQ ID NO: 19333 - protein, 469 aa, Artificial Sequence; identical to SEQ ID NO: 19325
  neuraminidase__InfluenzaA__ADL29882

SEQ ID NO: 19334 - protein, 469 aa, Artificial Sequence
  neuraminidase__InfluenzaA__ADL32020
MNPNQKIITIGSVCMTIGMANLILQIGNIISTWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19335 - protein, 469 aa, Artificial Sequence; identical to SEQ ID NO: 19325
  neuraminidase__InfluenzaA__ADL32030

SEQ ID NO: 19336 - protein, 469 aa, Artificial Sequence; identical to SEQ ID NO: 16738
  neuraminidase__InfluenzaA__ADL32040

SEQ ID NO: 19337 - protein, 469 aa, Artificial Sequence; identical to SEQ ID NO: 16738
  neuraminidase__InfluenzaA__ADL32050

SEQ ID NO: 19338 - protein, 469 aa, Artificial Sequence; identical to SEQ ID NO: 16738
  neuraminidase__InfluenzaA__ADL32060

SEQ ID NO: 19339 - protein, 469 aa, Artificial Sequence; identical to SEQ ID NO: 16738
  neuraminidase__InfluenzaA__ADL32093

SEQ ID NO: 19340 - protein, 469 aa, Artificial Sequence; identical to SEQ ID NO: 16738
  neuraminidase__InfluenzaA__ADL32117

SEQ ID NO: 19341 - protein, 469 aa, Artificial Sequence; identical to SEQ ID NO: 16738
  neuraminidase__InfluenzaA__ADL32347

SEQ ID NO: 19342 - protein, 469 aa, Artificial Sequence
  neuraminidase__InfluenzaA__ADL32357
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTVDK

SEQ ID NO: 19343 - protein, 469 aa, Artificial Sequence; identical to SEQ ID NO: 16738
  neuraminidase__InfluenzaA__ADL32367

SEQ ID NO: 19344 - protein, 469 aa, Artificial Sequence; identical to SEQ ID NO: 16738
  neuraminidase__InfluenzaA__ADL32377

SEQ ID NO: 19345 - protein, 469 aa, Artificial Sequence; identical to SEQ ID NO: 16738
  neuraminidase__InfluenzaA__ADL32387

SEQ ID NO: 19346 - protein, 469 aa, Artificial Sequence; identical to SEQ ID NO: 16738
  neuraminidase__InfluenzaA__ADL32397

SEQ ID NO: 19347 - protein, 469 aa, Artificial Sequence; identical to SEQ ID NO: 16738
  neuraminidase__InfluenzaA__ADL32407

SEQ ID NO: 19348 - protein, 469 aa, Artificial Sequence; identical to SEQ ID NO: 16738
  neuraminidase__InfluenzaA__ADL32417

SEQ ID NO: 19349 - protein, 469 aa, Artificial Sequence
  neuraminidase__InfluenzaA__ADL32427
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKEKTIWTSGSIISFCGVNSDTVGWSWPDGAELPFTIDK

SEQ ID NO: 19350 - protein, 469 aa, Artificial Sequence; identical to SEQ ID NO: 16738
  neuraminidase__InfluenzaA__ADL32447

SEQ ID NO: 19351 - protein, 469 aa, Artificial Sequence
  neuraminidase__InfluenzaA__ADL32457
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDKSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVSSDTVGWSWPDGAELPFTIDK

SEQ ID NO: 19352 - protein, 469 aa, Artificial Sequence; identical to SEQ ID NO: 17915
  neuraminidase__InfluenzaA__ADL32487

SEQ ID NO: 19353 - protein, 469 aa, Artificial Sequence; identical to SEQ ID NO: 16738
  neuraminidase__InfluenzaA__ADL32497

SEQ ID NO: 19354 - protein, 469 aa, Artificial Sequence; identical to SEQ ID NO: 16738
  neuraminidase__InfluenzaA__ADL32507

SEQ ID NO: 19355 - protein, 469 aa, Artificial Sequence; identical to SEQ ID NO: 18200
  neuraminidase__InfluenzaA__ADL32517

SEQ ID NO: 19356 - protein, 469 aa, Artificial Sequence; identical to SEQ ID NO: 17915
  neuraminidase__InfluenzaA__ADL32527

SEQ ID NO: 19357 - protein, 469 aa, Artificial Sequence; identical to SEQ ID NO: 16738
  neuraminidase__InfluenzaA__ADL32537

SEQ ID NO: 19358 - protein, 469 aa, Artificial Sequence; identical to SEQ ID NO: 17625
  neuraminidase__InfluenzaA__ADL32547

SEQ ID NO: 19359 - protein, 469 aa, Artificial Sequence; identical to SEQ ID NO: 18089
  neuraminidase__InfluenzaA__ADL32673

SEQ ID NO: 19360 - protein, 469 aa, Artificial Sequence; identical to SEQ ID NO: 16738
  neuraminidase__InfluenzaA__ADL32683

SEQ ID NO: 19361 - protein, 469 aa, Artificial Sequence; identical to SEQ ID NO: 16728
  neuraminidase__InfluenzaA__ADL32693

SEQ ID NO: 19362 - protein, 469 aa, Artificial Sequence; identical to SEQ ID NO: 17961
  neuraminidase__InfluenzaA__ADL32703

SEQ ID NO: 19363 - protein, 469 aa, Artificial Sequence; identical to SEQ ID NO: 16728
  neuraminidase__InfluenzaA__ADL32713

SEQ ID NO: 19364 - protein, 469 aa, Artificial Sequence; identical to SEQ ID NO: 16738
  neuraminidase__InfluenzaA__ADL32723

SEQ ID NO: 19365 - protein, 469 aa, Artificial Sequence; identical to SEQ ID NO: 18419
  neuraminidase__InfluenzaA__ADL32733

SEQ ID NO: 19366 - protein, 469 aa, Artificial Sequence; identical to SEQ ID NO: 18419
  neuraminidase__InfluenzaA__ADL32743

SEQ ID NO: 19367 - protein, 469 aa, Artificial Sequence
  neuraminidase__InfluenzaA__ADL39139
MNPNQKIITIGSVSLTISTICFFMQIAILITTVTLHFKQYEFNSPPNNQVMLSEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRERTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19368 - protein, 470 aa, Artificial Sequence
  neuraminidase__InfluenzaA__ADL39150
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19369 - protein, 469 aa, Artificial Sequence
  neuraminidase__InfluenzaA__ADL39172
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19370 - protein, 469 aa, Artificial Sequence; identical to SEQ ID NO: 16599
  neuraminidase__InfluenzaA__ADL39183

SEQ ID NO: 19371 - protein, 470 aa, Artificial Sequence; identical to SEQ ID NO: 18930
  neuraminidase__InfluenzaA__ADL39194

SEQ ID NO: 19372 - protein, 469 aa, Artificial Sequence; identical to SEQ ID NO: 16599
  neuraminidase__InfluenzaA__ADL39205

SEQ ID NO: 19373 - protein, 470 aa, Artificial Sequence; identical to SEQ ID NO: 17461
  neuraminidase__InfluenzaA__ADL39227

SEQ ID NO: 19374 - protein, 470 aa, Artificial Sequence; identical to SEQ ID NO: 18930
  neuraminidase__InfluenzaA__ADL39238

SEQ ID NO: 19375 - protein, 470 aa, Artificial Sequence; identical to SEQ ID NO: 18930
  neuraminidase__InfluenzaA__ADL39249

SEQ ID NO: 19376 - protein, 470 aa, Artificial Sequence; identical to SEQ ID NO: 17461
  neuraminidase__InfluenzaA__ADL39260

SEQ ID NO: 19377 - protein, 469 aa, Artificial Sequence
  neuraminidase__InfluenzaA__ADL39282
MNPNQKIITIGSVSLTISTICFFMQIAILITTVTLHFKQYEFNSPPNNQVMLCEPTIIEKNITEIVYLTNTTIEKEICPRLAEYRNWSKPQCDITGFAPFSKDNSIRLSAGGDIWVTREPYVSCDPDKCYQFALGQGTTLNNVHSNNKVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19378 - protein, 470 aa, Artificial Sequence; identical to SEQ ID NO: 17461
  neuraminidase__InfluenzaA__ADL39293

SEQ ID NO: 19379 - protein, 469 aa, Artificial Sequence
  neuraminidase__InfluenzaA__ADL39304
MNPNQKIITIGSVSLTISTICFFMQIAILITTVTLHFKQYEFNFPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19380 - protein, 469 aa, Artificial Sequence; identical to SEQ ID NO: 16599
  neuraminidase__InfluenzaA__ADL39326

SEQ ID NO: 19381 - protein, 470 aa, Artificial Sequence; identical to SEQ ID NO: 18930
  neuraminidase__InfluenzaA__ADL39392

SEQ ID NO: 19382 - protein, 469 aa, Artificial Sequence
  neuraminidase__InfluenzaA__ADL39403
MNPNQKIITIGSVSLTISTICFFMQIAILITTVTLHFKQYEFNPPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 19383 - protein, 470 aa, Artificial Sequence; identical to SEQ ID NO: 17461
  neuraminidase__InfluenzaA__ADL39425

SEQ ID NO: 19384 - protein, 470 aa, Artificial Sequence
  neuraminidase__InfluenzaA__ADL39447
MNPNQKIITIGSISIAIGIISLMLQIGSIISIWASHSIQTGSQNNTGICNQRIITYENSTWVNHTYVNINNTNVVAGEDKTSVTLTGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19385 - protein, 470 aa, Artificial Sequence; identical to SEQ ID NO: 17461
  neuraminidase__InfluenzaA__ADL39458

SEQ ID NO: 19386 - protein, 470 aa, Artificial Sequence
  neuraminidase__InfluenzaA__ADL39469
MNPNQKIITIGSISIAIGIISLMLQIGSIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELDAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19387 - protein, 470 aa, Artificial Sequence
  neuraminidase__InfluenzaA__ADL39480
MNPNQKIITIGSISIAIGIISLMLQIGSIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMVWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19388 - protein, 469 aa, Artificial Sequence
  neuraminidase__InfluenzaA__ADL39491
MNPNQKIITIGSVSLTISTICFFMQIAILITTVTLHFKQYEFNSSPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNIVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSSSIVVFCGTSGTYGTGSWPDGADINLMPI

SEQ ID NO: 19389 - protein, 469 aa, Artificial Sequence; identical to SEQ ID NO: 16738
  neuraminidase__InfluenzaA__ADL41165

SEQ ID NO: 19390 - protein, 469 aa, Artificial Sequence
  neuraminidase__InfluenzaA__ADL41175
MNPNQKIITIGSVCMTIGMANLILQIGNIISTWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19391 - protein, 470 aa, Artificial Sequence
  neuraminidase__InfluenzaA__ADL60255
MNPNQKIITIGSISIAIGIISLMLQIGNIISIWASHSIQTGSQNNTGICNQRIITYENSTWVNYTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPKDGRGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19392 - protein, 470 aa, Artificial Sequence
  neuraminidase__InfluenzaA__ADL60277
MNPNQRIITIGSISIAIGIISLMLQIGNIISIWASHSIQIGSQNNTGICNQRIITYENSTWVNHTYVNINNTNVVAGEDKTPVTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19393 - protein, 470 aa, Artificial Sequence
  neuraminidase__InfluenzaA__ADL60288
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPKDGKGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19394 - protein, 470 aa, Artificial Sequence
  neuraminidase__InfluenzaA__ADL60299
MNPNQKIITIGSISIAIGIISLMLQIGNIISIWASHSIQTGSQNNTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQDLDYQIGYICSGVFGDNPRPKDGKGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19395 - protein, 470 aa, Artificial Sequence; identical to SEQ ID NO: 16632
  neuraminidase__InfluenzaA__ADL60310

SEQ ID NO: 19396 - protein, 470 aa, Artificial Sequence
  neuraminidase__InfluenzaA__ADL60321
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGMVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19397 - protein, 470 aa, Artificial Sequence
  neuraminidase__InfluenzaA__ADL60332
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPKDGRGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19398 - protein, 470 aa, Artificial Sequence; identical to SEQ ID NO: 16632
  neuraminidase__InfluenzaA__ADL60343

SEQ ID NO: 19399 - protein, 470 aa, Artificial Sequence
  neuraminidase__InfluenzaA__ADL60354
MNPNQRIITIGSISIAIGIISLMLQIGNIISIWASHSIQIGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPKDGKGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19400 - protein, 469 aa, Artificial Sequence
  neuraminidase__InfluenzaA__ADL60365
MNPNQKIITIGSVSLTISTICFFMQIAILITTVTLHFKQYEFNSSPNNQVMLCEPTIIERNITEIVYLTNTTIEKEISPKLAEYRNWSKPQCDITGFAPFSKDNSIRLSAGGDIWVTREPYVSCDPDKCYQFALGQGTTLNNVHSNNIVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSTVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19401 - protein, 470 aa, Artificial Sequence
  neuraminidase__InfluenzaA__ADL60376
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTGKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPKDGKGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19402 - protein, 469 aa, Artificial Sequence; identical to SEQ ID NO: 16738
  neuraminidase__InfluenzaA__ADM07137

SEQ ID NO: 19403 - protein, 469 aa, Artificial Sequence; identical to SEQ ID NO: 16738
  neuraminidase__InfluenzaA__ADM07146

SEQ ID NO: 19404 - protein, 469 aa, Artificial Sequence; identical to SEQ ID NO: 16738
  neuraminidase__InfluenzaA__ADM07156

SEQ ID NO: 19405 - protein, 469 aa, Artificial Sequence; identical to SEQ ID NO: 16738
  neuraminidase__InfluenzaA__ADM07165

SEQ ID NO: 19406 - protein, 470 aa, Artificial Sequence; identical to SEQ ID NO: 17461
  neuraminidase__InfluenzaA__ADM07474

SEQ ID NO: 19407 - protein, 470 aa, Artificial Sequence; identical to SEQ ID NO: 17461
  neuraminidase__InfluenzaA__ADM07485

SEQ ID NO: 19408 - protein, 469 aa, Artificial Sequence
  neuraminidase__InfluenzaA__ADM07496
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINIMPI

SEQ ID NO: 19409 - protein, 469 aa, Artificial Sequence
  neuraminidase__InfluenzaA__ADM07507
MNPNQKIITIGSVSLTISTICFFMQTAILITTVTLHFKQFEFNSPPNNQVMLCEPAIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19410 - protein, 469 aa, Artificial Sequence
  neuraminidase__InfluenzaA__ADM12820
MNPNQKIITIGSVSLTISTICFFMQIAILITTVTLHFKQYKFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 19411 - protein, 469 aa, Artificial Sequence; identical to SEQ ID NO: 19410
  neuraminidase__InfluenzaA__ADM12831

SEQ ID NO: 19412 - protein, 469 aa, Artificial Sequence; identical to SEQ ID NO: 19410
  neuraminidase__InfluenzaA__ADM12842

SEQ ID NO: 19413 - protein, 469 aa, Artificial Sequence; identical to SEQ ID NO: 19410
  neuraminidase__InfluenzaA__ADM12853

SEQ ID NO: 19414 - protein, 469 aa, Artificial Sequence; identical to SEQ ID NO: 16738
  neuraminidase__InfluenzaA__ADM12864

SEQ ID NO: 19415 - protein, 469 aa, Artificial Sequence; identical to SEQ ID NO: 16738
  neuraminidase__InfluenzaA__ADM12874

SEQ ID NO: 19416 - protein, 469 aa, Artificial Sequence; identical to SEQ ID NO: 16738
  neuraminidase__InfluenzaA__ADM12884

SEQ ID NO: 19417 - protein, 469 aa, Artificial Sequence
  neuraminidase__InfluenzaA__ADM12894
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQSSYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19418 - protein, 469 aa, Artificial Sequence; identical to SEQ ID NO: 16738
  neuraminidase__InfluenzaA__ADM12904

SEQ ID NO: 19419 - protein, 469 aa, Artificial Sequence
  neuraminidase__InfluenzaA__ADM12914
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSYGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19420 - protein, 469 aa, Artificial Sequence; identical to SEQ ID NO: 16738
  neuraminidase__InfluenzaA__ADM12924

SEQ ID NO: 19421 - protein, 469 aa, Artificial Sequence; identical to SEQ ID NO: 16738
  neuraminidase__InfluenzaA__ADM12934

SEQ ID NO: 19422 - protein, 469 aa, Artificial Sequence; identical to SEQ ID NO: 16738
  neuraminidase__InfluenzaA__ADM12944

SEQ ID NO: 19423 - protein, 469 aa, Artificial Sequence; identical to SEQ ID NO: 16738
  neuraminidase__InfluenzaA__ADM12954

SEQ ID NO: 19424 - protein, 469 aa, Artificial Sequence; identical to SEQ ID NO: 16738
  neuraminidase__InfluenzaA__ADM12964

SEQ ID NO: 19425 - protein, 469 aa, Artificial Sequence; identical to SEQ ID NO: 18026
  neuraminidase__InfluenzaA__ADM12974

SEQ ID NO: 19426 - protein, 469 aa, Artificial Sequence
  neuraminidase__InfluenzaA__ADM12984
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIRSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19427 - protein, 469 aa, Artificial Sequence; identical to SEQ ID NO: 16738
  neuraminidase__InfluenzaA__ADM12994

SEQ ID NO: 19428 - protein, 469 aa, Artificial Sequence; identical to SEQ ID NO: 16738
  neuraminidase__InfluenzaA__ADM13004

SEQ ID NO: 19429 - protein, 469 aa, Artificial Sequence; identical to SEQ ID NO: 16738
  neuraminidase__InfluenzaA__ADM13014

SEQ ID NO: 19430 - protein, 469 aa, Artificial Sequence
  neuraminidase__InfluenzaA__ADM13034
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGNCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19431 - protein, 469 aa, Artificial Sequence; identical to SEQ ID NO: 18651
  neuraminidase__InfluenzaA__ADM13044

SEQ ID NO: 19432 - protein, 469 aa, Artificial Sequence; identical to SEQ ID NO: 17564
  neuraminidase__InfluenzaA__ADM13054

SEQ ID NO: 19433 - protein, 469 aa, Artificial Sequence; identical to SEQ ID NO: 17915
  neuraminidase__InfluenzaA__ADM13064

SEQ ID NO: 19434 - protein, 469 aa, Artificial Sequence
  neuraminidase__InfluenzaA__ADM13074
MNPNQKIITIGSVCMTIGMANLILQIGNIISIWISHSIQLGNQNQIETCNQSVITYENNTWVNQTYVNISNTNLAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 19435 - protein, 469 aa, Artificial Sequence; identical to SEQ ID NO: 17915
  neuraminidase__InfluenzaA__ADM13084

SEQ ID NO: 19436 - protein, 469 aa, Artificial Sequence
  neuraminidase__InfluenzaA__ADM13094
MNPNQKIITIGSVCMTIGMANLILQIGNTISIWISHSIQLGNQNQIETCNQSVITYENNTWVNQTYVNISNTNFAAGQSVVSAKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19437 - protein, 469 aa, Artificial Sequence; identical to SEQ ID NO: 17915
  neuraminidase__InfluenzaA__ADM13104

SEQ ID NO: 19438 - protein, 469 aa, Artificial Sequence; identical to SEQ ID NO: 18640
  neuraminidase__InfluenzaA__ADM13124

SEQ ID NO: 19439 - protein, 469 aa, Artificial Sequence
  neuraminidase__InfluenzaA__ADM13134
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNTLRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19440 - protein, 469 aa, Artificial Sequence
  neuraminidase__InfluenzaA__ADM13154
MNPNQKIITIGSVCMTIGMANLILQIGNIISIWISHSIQLGNQKQIETCNQSVFTYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19441 - protein, 469 aa, Artificial Sequence; identical to SEQ ID NO: 18168
  neuraminidase__InfluenzaA__ADM13164

SEQ ID NO: 19442 - protein, 469 aa, Artificial Sequence; identical to SEQ ID NO: 16738
  neuraminidase__InfluenzaA__ADM13174

SEQ ID NO: 19443 - protein, 469 aa, Artificial Sequence; identical to SEQ ID NO: 16738
  neuraminidase__InfluenzaA__ADM13184

SEQ ID NO: 19444 - protein, 469 aa, Artificial Sequence; identical to SEQ ID NO: 16738
  neuraminidase__InfluenzaA__ADM13194

SEQ ID NO: 19445 - protein, 469 aa, Artificial Sequence; identical to SEQ ID NO: 16738
  neuraminidase__InfluenzaA__ADM13204

SEQ ID NO: 19446 - protein, 469 aa, Artificial Sequence; identical to SEQ ID NO: 17915
  neuraminidase__InfluenzaA__ADM13214

SEQ ID NO: 19447 - protein, 469 aa, Artificial Sequence
  neuraminidase__InfluenzaA__ADM13224
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIRSWRNNILRTQESECACVNGSCFTVMTDGPSDGQASYKIFRIEKGKIVKSVEMNAPNYHYEECSCYPDSSKITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19448 - protein, 469 aa, Artificial Sequence; identical to SEQ ID NO: 16738
  neuraminidase__InfluenzaA__ADM13234

SEQ ID NO: 19449 - protein, 469 aa, Artificial Sequence; identical to SEQ ID NO: 18026
  neuraminidase__InfluenzaA__ADM13244

SEQ ID NO: 19450 - protein, 469 aa, Artificial Sequence; identical to SEQ ID NO: 17092
  neuraminidase__InfluenzaA__ADM13254

SEQ ID NO: 19451 - protein, 469 aa, Artificial Sequence; identical to SEQ ID NO: 17915
  neuraminidase__InfluenzaA__ADM13264

SEQ ID NO: 19452 - protein, 469 aa, Artificial Sequence; identical to SEQ ID NO: 16738
  neuraminidase__InfluenzaA__ADM13274

SEQ ID NO: 19453 - protein, 469 aa, Artificial Sequence; identical to SEQ ID NO: 16738
  neuraminidase__InfluenzaA__ADM13284

SEQ ID NO: 19454 - protein, 469 aa, Artificial Sequence
  neuraminidase__InfluenzaA__ADM13294
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRALMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNSFSIKQDIVGINEWSGYSGSFVQHPELTGLDCIRPCFWVELIRGRPKENTIWTSGSSISFCGVNSDTVGWSWPDGAELPFTIDK

SEQ ID NO: 19455 - protein, 469 aa, Artificial Sequence; identical to SEQ ID NO: 16738
  neuraminidase__InfluenzaA__ADM13304

SEQ ID NO: 19456 - protein, 469 aa, Artificial Sequence; identical to SEQ ID NO: 18200
  neuraminidase__InfluenzaA__ADM13314

SEQ ID NO: 19457 - protein, 469 aa, Artificial Sequence; identical to SEQ ID NO: 16738
  neuraminidase__InfluenzaA__ADM13324

SEQ ID NO: 19458 - protein, 469 aa, Artificial Sequence
  neuraminidase__InfluenzaA__ADM13344
MNPNQKIIIIGSVCMTIGMANLILQIGNIISIWILHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFAIKQDIVGINEWSGYSGSFVQHPELTGLDCIRPCFWVELIRGRPKENTIWTSGSSISFCGVNSDTVGWSWPDGAELPFTIDK

SEQ ID NO: 19459 - protein, 469 aa, Artificial Sequence; identical to SEQ ID NO: 18640
  neuraminidase__InfluenzaA__ADM13354

SEQ ID NO: 19460 - protein, 469 aa, Artificial Sequence; identical to SEQ ID NO: 17915
  neuraminidase__InfluenzaA__ADM13363

SEQ ID NO: 19461 - protein, 469 aa, Artificial Sequence
  neuraminidase__InfluenzaA__ADM13464
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGNDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGREQETRVWWTSNSIVVFCGTSGTYGTGSWPDGANINFMPI

SEQ ID NO: 19462 - protein, 469 aa, Artificial Sequence
  neuraminidase__InfluenzaA__ADM13465
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELMRGRKQETRVWWTSNSIVVFCGTSGTYGTGSWPDGANINFMPI

SEQ ID NO: 19463 - protein, 469 aa, Artificial Sequence; identical to SEQ ID NO: 14095
  neuraminidase__InfluenzaA__ADM13466

SEQ ID NO: 19464 - protein, 469 aa, Artificial Sequence
  neuraminidase__InfluenzaA__ADM13467
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSSGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 19465 - protein, 469 aa, Artificial Sequence; identical to SEQ ID NO: 14095
  neuraminidase__InfluenzaA__ADM13468

SEQ ID NO: 19466 - protein, 469 aa, Artificial Sequence
  neuraminidase__InfluenzaA__ADM13469
MNPNQKIITIGSVSLTIATACFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 19467 - protein, 469 aa, Artificial Sequence
  neuraminidase__InfluenzaA__ADM13470
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIIDSDNRSGYSGIFSVEGKSCINRCFYVELIRGRKQETRVWWTSNSIVVFCGTSGTYGTGSWPDGANINFMPI

SEQ ID NO: 19468 - protein, 469 aa, Artificial Sequence
  neuraminidase__InfluenzaA__ADM13471
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRISAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 19469 - protein, 469 aa, Artificial Sequence; identical to SEQ ID NO: 16508
  neuraminidase__InfluenzaA__ADM13472

SEQ ID NO: 19470 - protein, 469 aa, Artificial Sequence; identical to SEQ ID NO: 14095
  neuraminidase__InfluenzaA__ADM13473

SEQ ID NO: 19471 - protein, 469 aa, Artificial Sequence; identical to SEQ ID NO: 16503
  neuraminidase__InfluenzaA__ADM13474

SEQ ID NO: 19472 - protein, 469 aa, Artificial Sequence
  neuraminidase__InfluenzaA__ADM14469
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSMRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRTGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19473 - protein, 469 aa, Artificial Sequence; identical to SEQ ID NO: 16738
  neuraminidase__InfluenzaA__ADM14479

SEQ ID NO: 19474 - protein, 469 aa, Artificial Sequence; identical to SEQ ID NO: 16738
  neuraminidase__InfluenzaA__ADM14499

SEQ ID NO: 19475 - protein, 469 aa, Artificial Sequence; identical to SEQ ID NO: 18251
  neuraminidase__InfluenzaA__ADM14518

SEQ ID NO: 19476 - protein, 469 aa, Artificial Sequence; identical to SEQ ID NO: 19076
  neuraminidase__InfluenzaA__ADM14527

SEQ ID NO: 19477 - protein, 469 aa, Artificial Sequence; identical to SEQ ID NO: 18169
  neuraminidase__InfluenzaA__ADM14537

SEQ ID NO: 19478 - protein, 469 aa, Artificial Sequence; identical to SEQ ID NO: 16738
  neuraminidase__InfluenzaA__ADM14546

SEQ ID NO: 19479 - protein, 469 aa, Artificial Sequence
  neuraminidase__InfluenzaA__ADM14555
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFRYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19480 - protein, 469 aa, Artificial Sequence; identical to SEQ ID NO: 16738
  neuraminidase__InfluenzaA__ADM14573

SEQ ID NO: 19481 - protein, 469 aa, Artificial Sequence; identical to SEQ ID NO: 16738
  neuraminidase__InfluenzaA__ADM14582

SEQ ID NO: 19482 - protein, 469 aa, Artificial Sequence; identical to SEQ ID NO: 16738
  neuraminidase__InfluenzaA__ADM14591

SEQ ID NO: 19483 - protein, 469 aa, Artificial Sequence
  neuraminidase__InfluenzaA__ADM14601
MNPNQKIITIGSVCMTIGMANLILQIGNIISIWISHSIQLGNQNQIETCNQSVITYENNTWVNQTYVNISNTNFAAGQSVVSVKLAGNSSLCPVNGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19484 - protein, 469 aa, Artificial Sequence
  neuraminidase__InfluenzaA__ADM14611
MNPNQKIITIGSVCMTIGMANLILQIGNIISIWISHSIQLGNQNQIETCNQSVITYENNTWVNQTYVNISNTNFAAGQSVVSVKLSGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19485 - protein, 469 aa, Artificial Sequence; identical to SEQ ID NO: 16738
  neuraminidase__InfluenzaA__ADM14620

SEQ ID NO: 19486 - protein, 469 aa, Artificial Sequence; identical to SEQ ID NO: 16738
  neuraminidase__InfluenzaA__ADM14629

SEQ ID NO: 19487 - protein, 469 aa, Artificial Sequence; identical to SEQ ID NO: 16738
  neuraminidase__InfluenzaA__ADM14639

SEQ ID NO: 19488 - protein, 469 aa, Artificial Sequence; identical to SEQ ID NO: 16738
  neuraminidase__InfluenzaA__ADM14657

SEQ ID NO: 19489 - protein, 469 aa, Artificial Sequence; identical to SEQ ID NO: 16738
  neuraminidase__InfluenzaA__ADM14666

SEQ ID NO: 19490 - protein, 469 aa, Artificial Sequence; identical to SEQ ID NO: 16738
  neuraminidase__InfluenzaA__ADM14684

SEQ ID NO: 19491 - protein, 469 aa, Artificial Sequence
  neuraminidase__InfluenzaA__ADM14693
MNPNQKMITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19492 - protein, 469 aa, Artificial Sequence
  neuraminidase__InfluenzaA__ADM14702
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSHLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGAWIGRTKSTSSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19493 - protein, 469 aa, Artificial Sequence; identical to SEQ ID NO: 18640
  neuraminidase__InfluenzaA__ADM14711

SEQ ID NO: 19494 - protein, 469 aa, Artificial Sequence
  neuraminidase__InfluenzaA__ADM14720
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19495 - protein, 469 aa, Artificial Sequence
  neuraminidase__InfluenzaA__ADM14730
MNPNQKIITIGSVCMTIGMANLILQIGNIISIWISHSIQLGNQNQIETCNQSIITYENNTWVNQTYVNISNTNFAAGQSVVSVKLAGNSSLCPVSGWAVYSKDNSIRIGSKGDVLVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRSGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19496 - protein, 449 aa, Artificial Sequence
  neuraminidase__InfluenzaA__ADM14748
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRICRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19497 - protein, 469 aa, Artificial Sequence
  neuraminidase__InfluenzaA__ADM14758
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEINAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19498 - protein, 469 aa, Artificial Sequence; identical to SEQ ID NO: 19497
  neuraminidase__InfluenzaA__ADM14767

SEQ ID NO: 19499 - protein, 469 aa, Artificial Sequence; identical to SEQ ID NO: 16738
  neuraminidase__InfluenzaA__ADM14777

SEQ ID NO: 19500 - protein, 469 aa, Artificial Sequence; identical to SEQ ID NO: 16738
  neuraminidase__InfluenzaA__ADM14814

SEQ ID NO: 19501 - protein, 469 aa, Artificial Sequence; identical to SEQ ID NO: 16738
  neuraminidase__InfluenzaA__ADM14823

SEQ ID NO: 19502 - protein, 469 aa, Artificial Sequence; identical to SEQ ID NO: 18361
  neuraminidase__InfluenzaA__ADM14841

SEQ ID NO: 19503 - protein, 469 aa, Artificial Sequence; identical to SEQ ID NO: 18361
  neuraminidase__InfluenzaA__ADM14859

SEQ ID NO: 19504 - protein, 469 aa, Artificial Sequence; identical to SEQ ID NO: 17875
  neuraminidase__InfluenzaA__ADM14868

SEQ ID NO: 19505 - protein, 469 aa, Artificial Sequence; identical to SEQ ID NO: 18361
  neuraminidase__InfluenzaA__ADM14878

SEQ ID NO: 19506 - protein, 469 aa, Artificial Sequence; identical to SEQ ID NO: 16738
  neuraminidase__InfluenzaA__ADM14887

SEQ ID NO: 19507 - protein, 469 aa, Artificial Sequence
  neuraminidase__InfluenzaA__ADM14896
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVLVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19508 - protein, 469 aa, Artificial Sequence; identical to SEQ ID NO: 16738
  neuraminidase__InfluenzaA__ADM14905

SEQ ID NO: 19509 - protein, 469 aa, Artificial Sequence; identical to SEQ ID NO: 16738
  neuraminidase__InfluenzaA__ADM14923

SEQ ID NO: 19510 - protein, 469 aa, Artificial Sequence; identical to SEQ ID NO: 18026
  neuraminidase__InfluenzaA__ADM14932

SEQ ID NO: 19511 - protein, 469 aa, Artificial Sequence; identical to SEQ ID NO: 16738
  neuraminidase__InfluenzaA__ADM14950

SEQ ID NO: 19512 - protein, 469 aa, Artificial Sequence; identical to SEQ ID NO: 17756
  neuraminidase__InfluenzaA__ADM14959

SEQ ID NO: 19513 - protein, 469 aa, Artificial Sequence
  neuraminidase__InfluenzaA__ADM14977
MNPNQKIITIGSVCMTIGMANLILQIGNIISIWISHSIQLGNQNQIETCNQSVITYENNTWVNQTYVNISNTNFAAGQSVVSVKLAGNSSLCPVNGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19514 - protein, 469 aa, Artificial Sequence; identical to SEQ ID NO: 18361
  neuraminidase__InfluenzaA__ADM14987

SEQ ID NO: 19515 - protein, 469 aa, Artificial Sequence; identical to SEQ ID NO: 17905
  neuraminidase__InfluenzaA__ADM26787

SEQ ID NO: 19516 - protein, 469 aa, Artificial Sequence; identical to SEQ ID NO: 18484
  neuraminidase__InfluenzaA__ADM26798

SEQ ID NO: 19517 - protein, 469 aa, Artificial Sequence
  neuraminidase__InfluenzaA__ADM26809
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTVNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 19518 - protein, 469 aa, Artificial Sequence
  neuraminidase__InfluenzaA__ADM26820
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 19519 - protein, 449 aa, Artificial Sequence
  neuraminidase__InfluenzaA__ADM31427
MNPNQKIITIGSVCMIIGIVSLMLQIGNMISIWVSHSIQTGNQHQAEPIRNTNFLTENAVASVTLAGNSSLCPIRGWAVHSKDNSIRIGSKGDVFVIREPFISCSHMECRTFFLTQGALLNDKHSNGTVKDRSPHRTLMSCPVGEAPSPYNSRFESVAWSASACHDGISWLTIGISGPDNGAVAVLKYNGIITDTIKSWGNNILRTQESECACVNGSCFTVMTDGPSNGQASYKIFKIEKGKVVKSVELNAPNYHYEECSCYPDSGEIICVCRDNWHGSNRPWVSFNQNLEYQIGYICSGVFGDNPRPNDGTGSCGPMSPNGAYGIKGFSFKYGNGVWIGRTKSTNSRSGFEMIWDPNGWTGTDSEFSVKQDIVAITDWSGYSGSFVQHPELTGLDCIRPCFWVELIRGRPKESTIWTSGSSISFCGVNSDTVSWSWPDGAELPFTIDK

SEQ ID NO: 19520 - protein, 469 aa, Artificial Sequence
  neuraminidase__InfluenzaA__ADM31481
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDKGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19521 - protein, 469 aa, Artificial Sequence; identical to SEQ ID NO: 17321
  neuraminidase__InfluenzaA__ADM31491

SEQ ID NO: 19522 - protein, 469 aa, Artificial Sequence; identical to SEQ ID NO: 18943
  neuraminidase__InfluenzaA__ADM31501

SEQ ID NO: 19523 - protein, 469 aa, Artificial Sequence; identical to SEQ ID NO: 16738
  neuraminidase__InfluenzaA__ADM31511

SEQ ID NO: 19524 - protein, 469 aa, Artificial Sequence; identical to SEQ ID NO: 18939
  neuraminidase__InfluenzaA__ADM31521

SEQ ID NO: 19525 - protein, 469 aa, Artificial Sequence; identical to SEQ ID NO: 16738
  neuraminidase__InfluenzaA__ADM31531

SEQ ID NO: 19526 - protein, 469 aa, Artificial Sequence; identical to SEQ ID NO: 18026
  neuraminidase__InfluenzaA__ADM31541

SEQ ID NO: 19527 - protein, 469 aa, Artificial Sequence; identical to SEQ ID NO: 16738
  neuraminidase__InfluenzaA__ADM31551

SEQ ID NO: 19528 - protein, 469 aa, Artificial Sequence; identical to SEQ ID NO: 16738
  neuraminidase__InfluenzaA__ADM31561

SEQ ID NO: 19529 - protein, 469 aa, Artificial Sequence; identical to SEQ ID NO: 16738
  neuraminidase__InfluenzaA__ADM31571

SEQ ID NO: 19530 - protein, 469 aa, Artificial Sequence; identical to SEQ ID NO: 17915
  neuraminidase__InfluenzaA__ADM31581

SEQ ID NO: 19531 - protein, 469 aa, Artificial Sequence; identical to SEQ ID NO: 16738
  neuraminidase__InfluenzaA__ADM31601

SEQ ID NO: 19532 - protein, 469 aa, Artificial Sequence; identical to SEQ ID NO: 18026
  neuraminidase__InfluenzaA__ADM31611

SEQ ID NO: 19533 - protein, 469 aa, Artificial Sequence
  neuraminidase__InfluenzaA__ADM31621
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSSLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19534 - protein, 469 aa, Artificial Sequence; identical to SEQ ID NO: 18026
  neuraminidase__InfluenzaA__ADM31631

SEQ ID NO: 19535 - protein, 469 aa, Artificial Sequence; identical to SEQ ID NO: 17915
  neuraminidase__InfluenzaA__ADM31641

SEQ ID NO: 19536 - protein, 469 aa, Artificial Sequence; identical to SEQ ID NO: 18200
  neuraminidase__InfluenzaA__ADM31651

SEQ ID NO: 19537 - protein, 469 aa, Artificial Sequence; identical to SEQ ID NO: 17915
  neuraminidase__InfluenzaA__ADM31661

SEQ ID NO: 19538 - protein, 469 aa, Artificial Sequence
  neuraminidase__InfluenzaA__ADM31671
MNPNQKIITIGSVCMTIGMANLILQIGNIISIWISHSTQLGNQNQIETCNQSVITYENNTWVNQTYVNISNTNFAAGQSVVSAKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19539 - protein, 469 aa, Artificial Sequence; identical to SEQ ID NO: 18026
  neuraminidase__InfluenzaA__ADM31681

SEQ ID NO: 19540 - protein, 469 aa, Artificial Sequence
  neuraminidase__InfluenzaA__ADM31691
MNPNQKILTIGSVCMTIGMANLILQIGNIISIWISHSIQLGNQNQTETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19541 - protein, 469 aa, Artificial Sequence; identical to SEQ ID NO: 16738
  neuraminidase__InfluenzaA__ADM31701

SEQ ID NO: 19542 - protein, 469 aa, Artificial Sequence; identical to SEQ ID NO: 16738
  neuraminidase__InfluenzaA__ADM31711

SEQ ID NO: 19543 - protein, 469 aa, Artificial Sequence; identical to SEQ ID NO: 18026
  neuraminidase__InfluenzaA__ADM31721

SEQ ID NO: 19544 - protein, 469 aa, Artificial Sequence
  neuraminidase__InfluenzaA__ADM31731
MNPNQKIIIIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGRIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19545 - protein, 469 aa, Artificial Sequence; identical to SEQ ID NO: 19113
  neuraminidase__InfluenzaA__ADM31741

SEQ ID NO: 19546 - protein, 469 aa, Artificial Sequence; identical to SEQ ID NO: 16738
  neuraminidase__InfluenzaA__ADM31751

SEQ ID NO: 19547 - protein, 469 aa, Artificial Sequence
  neuraminidase__InfluenzaA__ADM31761
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNHNLEYQIGYICSGIFGDNPRPNDKTGSCGPVSSNGANGVKGFSFKYGNGVWIGRTKSISSRNGFEMIWDPNGWTGTDNKFSIKQDIVGISEWSGYSGSFVQHPELTGLDCIRPCFWVELIRGRPKENTIWTSGSSISFCGVNSDTVGWSWPDGAELPFTIDK

SEQ ID NO: 19548 - protein, 469 aa, Artificial Sequence
  neuraminidase__InfluenzaA__ADM31771
MNPNQKILTIGSVCMTIGMANLILQIGNIISIWISHSIQLGNQNQTETCNQSVIIYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19549 - protein, 469 aa, Artificial Sequence
  neuraminidase__InfluenzaA__ADM31801
MNPNQKIITIGSVCMTIGMANLILQIGNIISIWISHSIQLGNQNQIETCNQSVITYENNTWVNQTYVNINNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 19550 - protein, 469 aa, Artificial Sequence
  neuraminidase__InfluenzaA__ADM31811
MNPNQKIITIGSVCMTIGMANLILQIGNIISIWISHSIQLGNQNQIETCNQSVITYENNTWVNQTYVNISNTNFAAGQSVVSVKFAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 19551 - protein, 469 aa, Artificial Sequence; identical to SEQ ID NO: 17915
  neuraminidase__InfluenzaA__ADM31821

SEQ ID NO: 19552 - protein, 469 aa, Artificial Sequence; identical to SEQ ID NO: 16738
  neuraminidase__InfluenzaA__ADM31831

SEQ ID NO: 19553 - protein, 469 aa, Artificial Sequence; identical to SEQ ID NO: 16738
  neuraminidase__InfluenzaA__ADM31841

SEQ ID NO: 19554 - protein, 469 aa, Artificial Sequence
  neuraminidase__InfluenzaA__ADM31851
MNPNQKILTIGSVCMTIGMANLILQIGNIISIWISHSIQLGNQNQTETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIERGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19555 - protein, 469 aa, Artificial Sequence; identical to SEQ ID NO: 16738
  neuraminidase__InfluenzaA__ADM31861

SEQ ID NO: 19556 - protein, 469 aa, Artificial Sequence; identical to SEQ ID NO: 16738
  neuraminidase__InfluenzaA__ADM31871

SEQ ID NO: 19557 - protein, 469 aa, Artificial Sequence
  neuraminidase__InfluenzaA__ADM31881
MNPNQKIITIGSVCMTIGMANLILQIGNTISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19558 - protein, 469 aa, Artificial Sequence; identical to SEQ ID NO: 16738
  neuraminidase__InfluenzaA__ADM31891

SEQ ID NO: 19559 - protein, 469 aa, Artificial Sequence; identical to SEQ ID NO: 16728
  neuraminidase__InfluenzaA__ADM31901

SEQ ID NO: 19560 - protein, 469 aa, Artificial Sequence; identical to SEQ ID NO: 17961
  neuraminidase__InfluenzaA__ADM31911

SEQ ID NO: 19561 - protein, 469 aa, Artificial Sequence; identical to SEQ ID NO: 17961
  neuraminidase__InfluenzaA__ADM31921

SEQ ID NO: 19562 - protein, 469 aa, Artificial Sequence; identical to SEQ ID NO: 18419
  neuraminidase__InfluenzaA__ADM31931

SEQ ID NO: 19563 - protein, 469 aa, Artificial Sequence; identical to SEQ ID NO: 16728
  neuraminidase__InfluenzaA__ADM31941

SEQ ID NO: 19564 - protein, 469 aa, Artificial Sequence; identical to SEQ ID NO: 18419
  neuraminidase__InfluenzaA__ADM31951

SEQ ID NO: 19565 - protein, 469 aa, Artificial Sequence
  neuraminidase__InfluenzaA__ADM31961
MNPNQKIITIGSVCMAIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19566 - protein, 469 aa, Artificial Sequence
  neuraminidase__InfluenzaA__ADM31971
MNPNQKIITIGSVCMTIGMANLILQIGNIISIWISHSIQLGNQNQIETCNQSVITYENNTWVNQTYVNISNTNFAAGQSVVSMKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGVITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19567 - protein, 469 aa, Artificial Sequence; identical to SEQ ID NO: 17961
  neuraminidase__InfluenzaA__ADM31981

SEQ ID NO: 19568 - protein, 469 aa, Artificial Sequence; identical to SEQ ID NO: 16728
  neuraminidase__InfluenzaA__ADM31991

SEQ ID NO: 19569 - protein, 469 aa, Artificial Sequence; identical to SEQ ID NO: 16728
  neuraminidase__InfluenzaA__ADM32001

SEQ ID NO: 19570 - protein, 469 aa, Artificial Sequence; identical to SEQ ID NO: 16728
  neuraminidase__InfluenzaA__ADM32011

SEQ ID NO: 19571 - protein, 469 aa, Artificial Sequence; identical to SEQ ID NO: 16738
  neuraminidase__InfluenzaA__ADM32021

SEQ ID NO: 19572 - protein, 469 aa, Artificial Sequence; identical to SEQ ID NO: 17708
  neuraminidase__InfluenzaA__ADM32031

SEQ ID NO: 19573 - protein, 469 aa, Artificial Sequence; identical to SEQ ID NO: 18462
  neuraminidase__InfluenzaA__ADM32051

SEQ ID NO: 19574 - protein, 469 aa, Artificial Sequence; identical to SEQ ID NO: 16738
  neuraminidase__InfluenzaA__ADM32061

SEQ ID NO: 19575 - protein, 469 aa, Artificial Sequence; identical to SEQ ID NO: 16738
  neuraminidase__InfluenzaA__ADM32071

SEQ ID NO: 19576 - protein, 469 aa, Artificial Sequence; identical to SEQ ID NO: 16738
  neuraminidase__InfluenzaA__ADM32081

SEQ ID NO: 19577 - protein, 469 aa, Artificial Sequence; identical to SEQ ID NO: 17961
  neuraminidase__InfluenzaA__ADM32091

SEQ ID NO: 19578 - protein, 469 aa, Artificial Sequence; identical to SEQ ID NO: 16738
  neuraminidase__InfluenzaA__ADM32101

SEQ ID NO: 19579 - protein, 469 aa, Artificial Sequence; identical to SEQ ID NO: 16738
  neuraminidase__InfluenzaA__ADM32111

SEQ ID NO: 19580 - protein, 469 aa, Artificial Sequence; identical to SEQ ID NO: 18419
  neuraminidase__InfluenzaA__ADM32554

SEQ ID NO: 19581 - protein, 469 aa, Artificial Sequence; identical to SEQ ID NO: 16728
  neuraminidase__InfluenzaA__ADM32564

SEQ ID NO: 19582 - protein, 469 aa, Artificial Sequence; identical to SEQ ID NO: 17961
  neuraminidase__InfluenzaA__ADM32574

SEQ ID NO: 19583 - protein, 469 aa, Artificial Sequence; identical to SEQ ID NO: 16738
  neuraminidase__InfluenzaA__ADM32584

SEQ ID NO: 19584 - protein, 469 aa, Artificial Sequence; identical to SEQ ID NO: 18419
  neuraminidase__InfluenzaA__ADM32594

SEQ ID NO: 19585 - protein, 469 aa, Artificial Sequence; identical to SEQ ID NO: 16738
  neuraminidase__InfluenzaA__ADM32604

SEQ ID NO: 19586 - protein, 469 aa, Artificial Sequence; identical to SEQ ID NO: 16738
  neuraminidase__InfluenzaA__ADM32614

SEQ ID NO: 19587 - protein, 469 aa, Artificial Sequence; identical to SEQ ID NO: 16738
  neuraminidase__InfluenzaA__ADM32624

SEQ ID NO: 19588 - protein, 469 aa, Artificial Sequence; identical to SEQ ID NO: 18419
  neuraminidase__InfluenzaA__ADM32634

SEQ ID NO: 19589 - protein, 469 aa, Artificial Sequence; identical to SEQ ID NO: 16738
  neuraminidase__InfluenzaA__ADM32644

SEQ ID NO: 19590 - protein, 469 aa, Artificial Sequence; identical to SEQ ID NO: 16738
  neuraminidase__InfluenzaA__ADM32664

SEQ ID NO: 19591 - protein, 469 aa, Artificial Sequence; identical to SEQ ID NO: 17961
  neuraminidase__InfluenzaA__ADM32674

SEQ ID NO: 19592 - protein, 469 aa, Artificial Sequence; identical to SEQ ID NO: 16738
  neuraminidase__InfluenzaA__ADM32684

SEQ ID NO: 19593 - protein, 469 aa, Artificial Sequence; identical to SEQ ID NO: 16728
  neuraminidase__InfluenzaA__ADM32694

SEQ ID NO: 19594 - protein, 469 aa, Artificial Sequence; identical to SEQ ID NO: 16738
  neuraminidase__InfluenzaA__ADM32704

SEQ ID NO: 19595 - protein, 469 aa, Artificial Sequence; identical to SEQ ID NO: 18462
  neuraminidase__InfluenzaA__ADM32714

SEQ ID NO: 19596 - protein, 469 aa, Artificial Sequence; identical to SEQ ID NO: 18462
  neuraminidase__InfluenzaA__ADM32724

SEQ ID NO: 19597 - protein, 469 aa, Artificial Sequence; identical to SEQ ID NO: 16738
  neuraminidase__InfluenzaA__ADM32734

SEQ ID NO: 19598 - protein, 469 aa, Artificial Sequence; identical to SEQ ID NO: 17961
  neuraminidase__InfluenzaA__ADM32744

SEQ ID NO: 19599 - protein, 469 aa, Artificial Sequence; identical to SEQ ID NO: 18462
  neuraminidase__InfluenzaA__ADM32754

SEQ ID NO: 19600 - protein, 469 aa, Artificial Sequence; identical to SEQ ID NO: 17961
  neuraminidase__InfluenzaA__ADM32764

SEQ ID NO: 19601 - protein, 469 aa, Artificial Sequence
  neuraminidase__InfluenzaA__ADM32774
MNPNQKIIIIGSVCMTIGMANLILQIGNIISIWISHSIQLGNQNQIETCNQSVTTYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19602 - protein, 469 aa, Artificial Sequence; identical to SEQ ID NO: 17708
  neuraminidase__InfluenzaA__ADM32784

SEQ ID NO: 19603 - protein, 469 aa, Artificial Sequence; identical to SEQ ID NO: 17961
  neuraminidase__InfluenzaA__ADM32794

SEQ ID NO: 19604 - protein, 469 aa, Artificial Sequence
  neuraminidase__InfluenzaA__ADM32804
MNPNQKIITIGSVCMTIGMANLILQIGNIISIWISHSIQLGNQNQIETCNQSVITYENNTWVNQTYVNISNTNFAAGQSVVSVKLVGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVEINEWSGYSGSFVQHPELTGLDCIRPCFWVELIRGRPKENTIWTSGSSISFCGVNSDTVGWSWPDGAELPFTIDK

SEQ ID NO: 19605 - protein, 469 aa, Artificial Sequence
  neuraminidase__InfluenzaA__ADM32814
MNPNQKIITIGSVCMTIGMANLILQIGNIISIWISHSIQLGNQNQVETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19606 - protein, 469 aa, Artificial Sequence; identical to SEQ ID NO: 16738
  neuraminidase__InfluenzaA__ADM32824

SEQ ID NO: 19607 - protein, 469 aa, Artificial Sequence; identical to SEQ ID NO: 17961
  neuraminidase__InfluenzaA__ADM32834

SEQ ID NO: 19608 - protein, 469 aa, Artificial Sequence; identical to SEQ ID NO: 16728
  neuraminidase__InfluenzaA__ADM32844

SEQ ID NO: 19609 - protein, 469 aa, Artificial Sequence
  neuraminidase__InfluenzaA__ADM32854
MNPNQKIITIGSVCTTIGMANLILQIGNIISIWISHSIQFGNQNQIETCNQSVITYENNTWVNQTYVNISNTNFAAGQSVVSVKLVGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19610 - protein, 469 aa, Artificial Sequence; identical to SEQ ID NO: 16728
  neuraminidase__InfluenzaA__ADM32864

SEQ ID NO: 19611 - protein, 469 aa, Artificial Sequence; identical to SEQ ID NO: 16738
  neuraminidase__InfluenzaA__ADM32874

SEQ ID NO: 19612 - protein, 469 aa, Artificial Sequence
  neuraminidase__InfluenzaA__ADM32884
MNPNQKIITIGSVCMTIGMANLILQIGNIISIWISHSIQLGNQNQIETCNQSVITYENNTWVNQTYVNISNTNFAVGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 19613 - protein, 469 aa, Artificial Sequence; identical to SEQ ID NO: 16738
  neuraminidase__InfluenzaA__ADM32921

SEQ ID NO: 19614 - protein, 469 aa, Artificial Sequence; identical to SEQ ID NO: 16738
  neuraminidase__InfluenzaA__ADM32931

SEQ ID NO: 19615 - protein, 469 aa, Artificial Sequence
  neuraminidase__InfluenzaA__ADM32941
MNPNQKIIIIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSINSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19616 - protein, 469 aa, Artificial Sequence; identical to SEQ ID NO: 16738
  neuraminidase__InfluenzaA__ADM32951

SEQ ID NO: 19617 - protein, 469 aa, Artificial Sequence; identical to SEQ ID NO: 17321
  neuraminidase__InfluenzaA__ADM32960

SEQ ID NO: 19618 - protein, 469 aa, Artificial Sequence; identical to SEQ ID NO: 16738
  neuraminidase__InfluenzaA__ADM32969

SEQ ID NO: 19619 - protein, 469 aa, Artificial Sequence; identical to SEQ ID NO: 16738
  neuraminidase__InfluenzaA__ADM32979

SEQ ID NO: 19620 - protein, 469 aa, Artificial Sequence; identical to SEQ ID NO: 18640
  neuraminidase__InfluenzaA__ADM32988

SEQ ID NO: 19621 - protein, 469 aa, Artificial Sequence; identical to SEQ ID NO: 18640
  neuraminidase__InfluenzaA__ADM32997

SEQ ID NO: 19622 - protein, 469 aa, Artificial Sequence; identical to SEQ ID NO: 16738
  neuraminidase__InfluenzaA__ADM33006

SEQ ID NO: 19623 - protein, 469 aa, Artificial Sequence; identical to SEQ ID NO: 18640
  neuraminidase__InfluenzaA__ADM33015

SEQ ID NO: 19624 - protein, 469 aa, Artificial Sequence
  neuraminidase__InfluenzaA__ADM33025
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRSNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19625 - protein, 469 aa, Artificial Sequence; identical to SEQ ID NO: 16738
  neuraminidase__InfluenzaA__ADM33042

SEQ ID NO: 19626 - protein, 469 aa, Artificial Sequence; identical to SEQ ID NO: 16738
  neuraminidase__InfluenzaA__ADM33062

SEQ ID NO: 19627 - protein, 469 aa, Artificial Sequence
  neuraminidase__InfluenzaA__ADM33071
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSKITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNGDTVGWSWPDGAELPFTIDK

SEQ ID NO: 19628 - protein, 469 aa, Artificial Sequence; identical to SEQ ID NO: 16738
  neuraminidase__InfluenzaA__ADM33081

SEQ ID NO: 19629 - protein, 469 aa, Artificial Sequence; identical to SEQ ID NO: 17811
  neuraminidase__InfluenzaA__ADM33091

SEQ ID NO: 19630 - protein, 469 aa, Artificial Sequence; identical to SEQ ID NO: 17811
  neuraminidase__InfluenzaA__ADM33101

SEQ ID NO: 19631 - protein, 469 aa, Artificial Sequence; identical to SEQ ID NO: 17811
  neuraminidase__InfluenzaA__ADM33111

SEQ ID NO: 19632 - protein, 469 aa, Artificial Sequence; identical to SEQ ID NO: 16738
  neuraminidase__InfluenzaA__ADM33121

SEQ ID NO: 19633 - protein, 469 aa, Artificial Sequence; identical to SEQ ID NO: 16738
  neuraminidase__InfluenzaA__ADM33130

SEQ ID NO: 19634 - protein, 469 aa, Artificial Sequence; identical to SEQ ID NO: 16738
  neuraminidase__InfluenzaA__ADM33139

SEQ ID NO: 19635 - protein, 469 aa, Artificial Sequence; identical to SEQ ID NO: 16738
  neuraminidase__InfluenzaA__ADM33149

SEQ ID NO: 19636 - protein, 469 aa, Artificial Sequence; identical to SEQ ID NO: 16738
  neuraminidase__InfluenzaA__ADM33159

SEQ ID NO: 19637 - protein, 469 aa, Artificial Sequence; identical to SEQ ID NO: 16738
  neuraminidase__InfluenzaA__ADM33169

SEQ ID NO: 19638 - protein, 469 aa, Artificial Sequence; identical to SEQ ID NO: 16738
  neuraminidase__InfluenzaA__ADM33179

SEQ ID NO: 19639 - protein, 469 aa, Artificial Sequence; identical to SEQ ID NO: 16738
  neuraminidase__InfluenzaA__ADM33188

SEQ ID NO: 19640 - protein, 469 aa, Artificial Sequence; identical to SEQ ID NO: 16738
  neuraminidase__InfluenzaA__ADM33197

SEQ ID NO: 19641 - protein, 469 aa, Artificial Sequence; identical to SEQ ID NO: 16738
  neuraminidase__InfluenzaA__ADM33206

SEQ ID NO: 19642 - protein, 469 aa, Artificial Sequence; identical to SEQ ID NO: 16738
  neuraminidase__InfluenzaA__ADM33215

SEQ ID NO: 19643 - protein, 469 aa, Artificial Sequence; identical to SEQ ID NO: 16738
  neuraminidase__InfluenzaA__ADM33224

SEQ ID NO: 19644 - protein, 469 aa, Artificial Sequence; identical to SEQ ID NO: 16738
  neuraminidase__InfluenzaA__ADM33234

SEQ ID NO: 19645 - protein, 469 aa, Artificial Sequence; identical to SEQ ID NO: 17162
  neuraminidase__InfluenzaA__ADM33243

SEQ ID NO: 19646 - protein, 469 aa, Artificial Sequence; identical to SEQ ID NO: 16738
  neuraminidase__InfluenzaA__ADM33253

SEQ ID NO: 19647 - protein, 469 aa, Artificial Sequence; identical to SEQ ID NO: 17162
  neuraminidase__InfluenzaA__ADM33262

SEQ ID NO: 19648 - protein, 469 aa, Artificial Sequence; identical to SEQ ID NO: 16768
  neuraminidase__InfluenzaA__ADM33272

SEQ ID NO: 19649 - protein, 469 aa, Artificial Sequence; identical to SEQ ID NO: 16768
  neuraminidase__InfluenzaA__ADM33282

SEQ ID NO: 19650 - protein, 469 aa, Artificial Sequence; identical to SEQ ID NO: 16738
  neuraminidase__InfluenzaA__ADM33292

SEQ ID NO: 19651 - protein, 469 aa, Artificial Sequence; identical to SEQ ID NO: 16738
  neuraminidase__InfluenzaA__ADM33302

SEQ ID NO: 19652 - protein, 469 aa, Artificial Sequence; identical to SEQ ID NO: 16728
  neuraminidase__InfluenzaA__ADM33312

SEQ ID NO: 19653 - protein, 469 aa, Artificial Sequence; identical to SEQ ID NO: 16768
  neuraminidase__InfluenzaA__ADM33322

SEQ ID NO: 19654 - protein, 469 aa, Artificial Sequence; identical to SEQ ID NO: 16768
  neuraminidase__InfluenzaA__ADM33332

SEQ ID NO: 19655 - protein, 469 aa, Artificial Sequence; identical to SEQ ID NO: 16768
  neuraminidase__InfluenzaA__ADM33342

SEQ ID NO: 19656 - protein, 469 aa, Artificial Sequence
  neuraminidase__InfluenzaA__ADM33367
MNPNQKIITIGSVCMTIGMANLILQIGNIISIWISHSIQLGNQNQIETCNQSVVTYENNTWVNQTYVNISNTNFAAGQSVVSVKLAGNSSLCPVGGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19657 - protein, 469 aa, Artificial Sequence; identical to SEQ ID NO: 16768
  neuraminidase__InfluenzaA__ADM33377

SEQ ID NO: 19658 - protein, 469 aa, Artificial Sequence; identical to SEQ ID NO: 16768
  neuraminidase__InfluenzaA__ADM33387

SEQ ID NO: 19659 - protein, 469 aa, Artificial Sequence; identical to SEQ ID NO: 16738
  neuraminidase__InfluenzaA__ADM33397

SEQ ID NO: 19660 - protein, 469 aa, Artificial Sequence; identical to SEQ ID NO: 16738
  neuraminidase__InfluenzaA__ADM33407

SEQ ID NO: 19661 - protein, 469 aa, Artificial Sequence; identical to SEQ ID NO: 16768
  neuraminidase__InfluenzaA__ADM33417

SEQ ID NO: 19662 - protein, 469 aa, Artificial Sequence; identical to SEQ ID NO: 16738
  neuraminidase__InfluenzaA__ADM33427

SEQ ID NO: 19663 - protein, 469 aa, Artificial Sequence
  neuraminidase__InfluenzaA__ADM33437
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSAYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19664 - protein, 469 aa, Artificial Sequence; identical to SEQ ID NO: 17092
  neuraminidase__InfluenzaA__ADM33443

SEQ ID NO: 19665 - protein, 469 aa, Artificial Sequence; identical to SEQ ID NO: 16738
  neuraminidase__InfluenzaA__ADM52446

SEQ ID NO: 19666 - protein, 469 aa, Artificial Sequence; identical to SEQ ID NO: 16738
  neuraminidase__InfluenzaA__ADM52456

SEQ ID NO: 19667 - protein, 469 aa, Artificial Sequence; identical to SEQ ID NO: 18943
  neuraminidase__InfluenzaA__ADM52466

SEQ ID NO: 19668 - protein, 469 aa, Artificial Sequence; identical to SEQ ID NO: 16738
  neuraminidase__InfluenzaA__ADM52486

SEQ ID NO: 19669 - protein, 469 aa, Artificial Sequence; identical to SEQ ID NO: 16728
  neuraminidase__InfluenzaA__ADM52496

SEQ ID NO: 19670 - protein, 469 aa, Artificial Sequence; identical to SEQ ID NO: 16738
  neuraminidase__InfluenzaA__ADM52506

SEQ ID NO: 19671 - protein, 469 aa, Artificial Sequence; identical to SEQ ID NO: 16728
  neuraminidase__InfluenzaA__ADM52516

SEQ ID NO: 19672 - protein, 469 aa, Artificial Sequence; identical to SEQ ID NO: 16728
  neuraminidase__InfluenzaA__ADM52527

SEQ ID NO: 19673 - protein, 469 aa, Artificial Sequence; identical to SEQ ID NO: 17961
  neuraminidase__InfluenzaA__ADM52537

SEQ ID NO: 19674 - protein, 469 aa, Artificial Sequence; identical to SEQ ID NO: 18462
  neuraminidase__InfluenzaA__ADM52547

SEQ ID NO: 19675 - protein, 469 aa, Artificial Sequence; identical to SEQ ID NO: 16728
  neuraminidase__InfluenzaA__ADM52557

SEQ ID NO: 19676 - protein, 469 aa, Artificial Sequence; identical to SEQ ID NO: 16728
  neuraminidase__InfluenzaA__ADM52567

SEQ ID NO: 19677 - protein, 469 aa, Artificial Sequence; identical to SEQ ID NO: 16728
  neuraminidase__InfluenzaA__ADM52577

SEQ ID NO: 19678 - protein, 469 aa, Artificial Sequence; identical to SEQ ID NO: 16738
  neuraminidase__InfluenzaA__ADM52587

SEQ ID NO: 19679 - protein, 469 aa, Artificial Sequence; identical to SEQ ID NO: 16738
  neuraminidase__InfluenzaA__ADM52597

SEQ ID NO: 19680 - protein, 469 aa, Artificial Sequence; identical to SEQ ID NO: 16728
  neuraminidase__InfluenzaA__ADM52607

SEQ ID NO: 19681 - protein, 469 aa, Artificial Sequence; identical to SEQ ID NO: 16728
  neuraminidase__InfluenzaA__ADM52617

SEQ ID NO: 19682 - protein, 469 aa, Artificial Sequence; identical to SEQ ID NO: 18419
  neuraminidase__InfluenzaA__ADM52627

SEQ ID NO: 19683 - protein, 469 aa, Artificial Sequence; identical to SEQ ID NO: 17961
  neuraminidase__InfluenzaA__ADM52637

SEQ ID NO: 19684 - protein, 469 aa, Artificial Sequence; identical to SEQ ID NO: 17961
  neuraminidase__InfluenzaA__ADM52647

SEQ ID NO: 19685 - protein, 469 aa, Artificial Sequence; identical to SEQ ID NO: 16728
  neuraminidase__InfluenzaA__ADM52657

SEQ ID NO: 19686 - protein, 469 aa, Artificial Sequence; identical to SEQ ID NO: 17961
  neuraminidase__InfluenzaA__ADM52667

SEQ ID NO: 19687 - protein, 469 aa, Artificial Sequence; identical to SEQ ID NO: 16728
  neuraminidase__InfluenzaA__ADM52687

SEQ ID NO: 19688 - protein, 469 aa, Artificial Sequence; identical to SEQ ID NO: 16728
  neuraminidase__InfluenzaA__ADM52697

SEQ ID NO: 19689 - protein, 469 aa, Artificial Sequence; identical to SEQ ID NO: 18419
  neuraminidase__InfluenzaA__ADM52707

SEQ ID NO: 19690 - protein, 469 aa, Artificial Sequence
  neuraminidase__InfluenzaA__ADM52717
MNPNQKIITIGSVCMTIGMANLILQIGNIISIWISHSIQLGNQNQIETCNQSVITYENNTWVNQTYVNISNTNFAAGQSAVSVKLVGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19691 - protein, 469 aa, Artificial Sequence
  neuraminidase__InfluenzaA__ADM86402
MNPNQKIITIGSVCMTIGMANLILQIGNIISIWISHSIQLGNQNQIETCNQSVITYENNTWVNQTYVNISNTNFAAGQSVASVKLAGNSSLCPVSGWAIYSKDNSVRIGSKGDVFVIREPFISCSPLECRTFFLTQGALLNDKHSNGTVKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19692 - protein, 469 aa, Artificial Sequence; identical to SEQ ID NO: 16738
  neuraminidase__InfluenzaA__ADM86412

SEQ ID NO: 19693 - protein, 469 aa, Artificial Sequence
  neuraminidase__InfluenzaA__ADM86422
MNPNQKIITIGSVCMTIGMANLILQIGNIISIWISHSIQLGNQNQIETCNQSVITYENNTWVNQTYVNISNTNFVAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKVVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19694 - protein, 469 aa, Artificial Sequence; identical to SEQ ID NO: 17592
  neuraminidase__InfluenzaA__ADM86432

SEQ ID NO: 19695 - protein, 469 aa, Artificial Sequence
  neuraminidase__InfluenzaA__ADM86443
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECVCVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGMNEWSGYSGSFVQHPELTGLDCIRPCFWVELIRGRPKENTIWTSGSSISFCGVNSDTVGWSWPDGAELPFTIDK

SEQ ID NO: 19696 - protein, 469 aa, Artificial Sequence; identical to SEQ ID NO: 17321
  neuraminidase__InfluenzaA__ADM86453

SEQ ID NO: 19697 - protein, 449 aa, Artificial Sequence
  neuraminidase__InfluenzaA__ADM95377
MNPNQKIITIGSICMVTGIVSLMLQVGSMISIWVSHSIHTGNQHQAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPMGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVIKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSRFSVKQDIVAITDWSGYSGSFVQHPELTGLDCIRPCFWVELIRGRPKESTIWTSGSSISFCGVNSDTVGWSWPDGAELPFTIDK

SEQ ID NO: 19698 - protein, 469 aa, Artificial Sequence; identical to SEQ ID NO: 16738
  neuraminidase__InfluenzaA__ADM95650

SEQ ID NO: 19699 - protein, 469 aa, Artificial Sequence; identical to SEQ ID NO: 16738
  neuraminidase__InfluenzaA__ADM95651

SEQ ID NO: 19700 - protein, 469 aa, Artificial Sequence
  neuraminidase__InfluenzaA__ADM95652
MNPNQKIITIGSVCMTIGMANLILQIGNIISIWISHSIQLGNQNQIETCNQSVITYENNTWVNQTYVNISNTNFAAGQSVVSVKFAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGNCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19701 - protein, 469 aa, Artificial Sequence
  neuraminidase__InfluenzaA__ADM95654
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRHGFEMIWDPNGWTGTDNNFSIKQDIVGTNEWSGYSGSFVQHPELTGLDCIRPCFWVELIRGRPKENTIWTSGSSISFCGVNSDTVGWSWPDGAELPFTIDK

SEQ ID NO: 19702 - protein, 469 aa, Artificial Sequence
  neuraminidase__InfluenzaA__ADM95655
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPSDKTGSCGPVSSNGANGVKGFSFKYGNGVWIGRTKSISSRNGFEMIWDPNGWTGTDNDFSIKQDIVGINEWSGYSGSFVQHPELTGLDCIRPCFWVELIRGRPKENTIWTSGSSISFCGVNSDTVGWSWPDGAELPFTIDK

SEQ ID NO: 19703 - protein, 469 aa, Artificial Sequence; identical to SEQ ID NO: 18350
  neuraminidase__InfluenzaA__ADM95656

SEQ ID NO: 19704 - protein, 469 aa, Artificial Sequence; identical to SEQ ID NO: 17915
  neuraminidase__InfluenzaA__ADM95658

SEQ ID NO: 19705 - protein, 469 aa, Artificial Sequence
  neuraminidase__InfluenzaA__ADM95659
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRSGFEMIWDPNGWTGTDNNFSIKQDIIGTNEWSGYSGSFVQHPELTGLDCIRPCFWVELIRGRPKENTIWTSGSSISFCGVNSDTVGWSWPDGAELPFTIDK

SEQ ID NO: 19706 - protein, 469 aa, Artificial Sequence; identical to SEQ ID NO: 16738
  neuraminidase__InfluenzaA__ADM95660

SEQ ID NO: 19707 - protein, 469 aa, Artificial Sequence
  neuraminidase__InfluenzaA__ADM95661
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGTNEWSGYSGSFVQHPELTGLDCIRPCFWVELIRGRPKENTIWTSGSIISFCGVNSDTVGWSWPDGAELPFTIDK

SEQ ID NO: 19708 - protein, 469 aa, Artificial Sequence; identical to SEQ ID NO: 18350
  neuraminidase__InfluenzaA__ADM95662

SEQ ID NO: 19709 - protein, 469 aa, Artificial Sequence
  neuraminidase__InfluenzaA__ADM95663
MNPNQKIITIGSVCMTIGMANLILQIGNIISIWISHSIQLGNQNQIETCNQSVITYENNTWVNQTYVNISNTNFAAGQSVVSVKLAGNSSLCPVNGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSIEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGTNEWSGYSGSFVQHPELTGLDCIRPCFWVELIRGRPKENTIWTSGSIISFCGVNSDTVGWSWPDGAELPFTIDK

SEQ ID NO: 19710 - protein, 469 aa, Artificial Sequence; identical to SEQ ID NO: 18350
  neuraminidase__InfluenzaA__ADM95664

SEQ ID NO: 19711 - protein, 469 aa, Artificial Sequence; identical to SEQ ID NO: 18350
  neuraminidase__InfluenzaA__ADM95665

SEQ ID NO: 19712 - protein, 469 aa, Artificial Sequence
  neuraminidase__InfluenzaA__ADM95666
MNPNQKIITIGSVCMTIGMANLILQIGNIISIWISHSIQLGNQNQIETCNQSVITYENNTWVNQTYVNISNTNFAAGQSVVSVKLAGNSSLCPVNGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCGPVSFNGANGVKGFSFKYGNGVWIGRTKSISSRNGFEMIWDPNGWTGTDNNFSIKQDIVGTNEWSGYSGSFVQHPELTGLDCIRPCFWVELIRGRPKENTIWTSGSIISFCGVNSDTVGWSWPDGAELPFTIDK

SEQ ID NO: 19713 - protein, 469 aa, Artificial Sequence; identical to SEQ ID NO: 18350
  neuraminidase__InfluenzaA__ADM95667

SEQ ID NO: 19714 - protein, 469 aa, Artificial Sequence; identical to SEQ ID NO: 18350
  neuraminidase__InfluenzaA__ADM95668

SEQ ID NO: 19715 - protein, 469 aa, Artificial Sequence; identical to SEQ ID NO: 16738
  neuraminidase__InfluenzaA__ADM95669

SEQ ID NO: 19716 - protein, 469 aa, Artificial Sequence; identical to SEQ ID NO: 16738
  neuraminidase__InfluenzaA__ADM95670

SEQ ID NO: 19717 - protein, 469 aa, Artificial Sequence
  neuraminidase__InfluenzaA__ADM95672
MNPNQKIITIGSVCMTIGMANLILQIGNIISIWISHTIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGTNEWSGYSGSFVQHPELTGLDCIRPCFWVELIRGRPKENTIWTSGSSISFCGVNSDTVGWSWPDGAELPFTIDK

SEQ ID NO: 19718 - protein, 469 aa, Artificial Sequence; identical to SEQ ID NO: 16738
  neuraminidase__InfluenzaA__ADM95673

SEQ ID NO: 19719 - protein, 469 aa, Artificial Sequence; identical to SEQ ID NO: 18350
  neuraminidase__InfluenzaA__ADM95674

SEQ ID NO: 19720 - protein, 469 aa, Artificial Sequence; identical to SEQ ID NO: 16738
  neuraminidase__InfluenzaA__ADM95675

SEQ ID NO: 19721 - protein, 469 aa, Artificial Sequence
  neuraminidase__InfluenzaA__ADM95677
MNPNQKIITIGSVCMTIGMANLILQIGNIISIWISHSIQLGNQNQIETCNQSVITYENNTWVNQTYVNISNTNFAAGQSVVSVKLAGNSSLCPVNGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGTNEWSGYSGSFVQHPELTGLDCIRPCFWVELIRGRPKENTIWTSGSIISFCGVNSDTVGWSWPDGAELPFTIDK

SEQ ID NO: 19722 - protein, 469 aa, Artificial Sequence
  neuraminidase__InfluenzaA__ADM95678
MNPNQKIITIGSVCMTIGMANLILQIGNIISIWISHSIQLGNQNQIETCNQSVITYENNTWVNQTYVNISNTNFAAGQSVVSVKFAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19723 - protein, 469 aa, Artificial Sequence; identical to SEQ ID NO: 19721
  neuraminidase__InfluenzaA__ADM95679

SEQ ID NO: 19724 - protein, 469 aa, Artificial Sequence; identical to SEQ ID NO: 19721
  neuraminidase__InfluenzaA__ADM95680

SEQ ID NO: 19725 - protein, 469 aa, Artificial Sequence; identical to SEQ ID NO: 16738
  neuraminidase__InfluenzaA__ADM95681

SEQ ID NO: 19726 - protein, 469 aa, Artificial Sequence
  neuraminidase__InfluenzaA__ADM95682
MNPNQKIITIGSVCMTIGMANLILQIGNIISIWISHSIQLGNQNQIEICNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGTNEWSGYSGSFVQHPELTGLDCIRPCFWVELIRGRPKENTIWTSGSSISFCGVNSDTVGWSWPDGAELPFTIDK

SEQ ID NO: 19727 - protein, 469 aa, Artificial Sequence
  neuraminidase__InfluenzaA__ADM95683
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSMSFCGVNSDTVGWSWPDGAELPFTIDK

SEQ ID NO: 19728 - protein, 469 aa, Artificial Sequence; identical to SEQ ID NO: 16738
  neuraminidase__InfluenzaA__ADM95684

SEQ ID NO: 19729 - protein, 469 aa, Artificial Sequence
  neuraminidase__InfluenzaA__ADM95685
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRHGFEMIWDPNGWTGTDNNFSIKQDIVGTNEWSGYSGSFVQHPELTGLDCIRPCFWVELIRGRPKENTVWTSGSSISFCGVNSDTVGWSWPDGAELPFTIDK

SEQ ID NO: 19730 - protein, 469 aa, Artificial Sequence
  neuraminidase__InfluenzaA__ADM95686
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNDFSIKQDIVGINEWSGYSGSFVQHPELTGLDCIRPCFWVELIRGRPKENTIWTSGSSISFCGVNSDTVGWSWPDGAELPFTIDK

SEQ ID NO: 19731 - protein, 469 aa, Artificial Sequence; identical to SEQ ID NO: 16738
  neuraminidase__InfluenzaA__ADM95687

SEQ ID NO: 19732 - protein, 469 aa, Artificial Sequence
  neuraminidase__InfluenzaA__ADM95688
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGTNEWSGYSGSFVQHPELTRLDCIRPCFWVELIRGRPKENTIWTSGSIISFCGVNSDTVGWSWPDGAELPFTIDK

SEQ ID NO: 19733 - protein, 469 aa, Artificial Sequence; identical to SEQ ID NO: 19730
  neuraminidase__InfluenzaA__ADM95689

SEQ ID NO: 19734 - protein, 469 aa, Artificial Sequence
  neuraminidase__InfluenzaA__ADM95690
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIIGTNEWSGYSGSFVQHPELTGLDCIRPCFWVELIRGRPKENTIWTSGSSISFCGVNSDTVGWSWPDGAELPFTIDK

SEQ ID NO: 19735 - protein, 469 aa, Artificial Sequence; identical to SEQ ID NO: 16738
  neuraminidase__InfluenzaA__ADM95691

SEQ ID NO: 19736 - protein, 469 aa, Artificial Sequence
  neuraminidase__InfluenzaA__ADM95692
MNPNQKIITIGSVCMTIGMANLILQIGNIISIWISHSIQLGNQNQIETCNQSVITYENNTWVNQTYVNIINTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19737 - protein, 469 aa, Artificial Sequence; identical to SEQ ID NO: 16738
  neuraminidase__InfluenzaA__ADM95693

SEQ ID NO: 19738 - protein, 469 aa, Artificial Sequence; identical to SEQ ID NO: 16738
  neuraminidase__InfluenzaA__ADM95694

SEQ ID NO: 19739 - protein, 469 aa, Artificial Sequence; identical to SEQ ID NO: 16738
  neuraminidase__InfluenzaA__ADM95695

SEQ ID NO: 19740 - protein, 469 aa, Artificial Sequence; identical to SEQ ID NO: 19730
  neuraminidase__InfluenzaA__ADM95696

SEQ ID NO: 19741 - protein, 469 aa, Artificial Sequence; identical to SEQ ID NO: 18350
  neuraminidase__InfluenzaA__ADM95697

SEQ ID NO: 19742 - protein, 470 aa, Artificial Sequence
  neuraminidase__InfluenzaA__ADM95698
MNPNQKIITIGSISIAIGIISLMLQIGNIISIWASHSIQTGSQNNTGICNQRIITYENNTWVNHTYVNINNTNVVAEEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGQPRENTTIWTSGSSISFCGVNSDTANWSWPDGAELPFTIDK

SEQ ID NO: 19743 - protein, 470 aa, Artificial Sequence
  neuraminidase__InfluenzaA__ADM95699
MNPNQKIITIGSISIAIGIISLMLQIGNIISIWASHSIQTGSQNNTGICNQRIITYENNTWVNHTYVNINNTNVVAEEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19744 - protein, 470 aa, Artificial Sequence
  neuraminidase__InfluenzaA__ADM95701
MNPNQKIITIGSISIAIGIISLMLQIGNIISIWASHSIQTGSQNNTGICNQRIITYENNTWVNHTYVNINNTNVVAEEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19745 - protein, 470 aa, Artificial Sequence
  neuraminidase__InfluenzaA__ADM95702
MNPNQKIITIGSISIAIGIISLMLQIGNIISIWASHSIQTGRQNNTGICNQRIITYENSTWVNHTYVNINNTKVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEVIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19746 - protein, 470 aa, Artificial Sequence
  neuraminidase__InfluenzaA__ADM95704
MNPNQKIITIGSISIAIGIISLMLQIGNIVSIWASHSIQTGSQNNTGICNQRIITYENNTWVNHTYVNINNTNVVAEEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNRAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19747 - protein, 470 aa, Artificial Sequence
  neuraminidase__InfluenzaA__ADM95705
MNPNQKIITIGSISIAIGIISLMLQIGNIISIWASHSIQTGRQNNTGICNQRIITYENSTWVNHTYVNINNTKVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19748 - protein, 470 aa, Artificial Sequence; identical to SEQ ID NO: 19747
  neuraminidase__InfluenzaA__ADM95706

SEQ ID NO: 19749 - protein, 470 aa, Artificial Sequence; identical to SEQ ID NO: 19747
  neuraminidase__InfluenzaA__ADM95707

SEQ ID NO: 19750 - protein, 470 aa, Artificial Sequence; identical to SEQ ID NO: 17461
  neuraminidase__InfluenzaA__ADM95708

SEQ ID NO: 19751 - protein, 469 aa, Artificial Sequence
  neuraminidase__InfluenzaA__ADM95710
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHNIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETDVLWTSNSIVVFCGTSGTYGTGSWPDGADINLMPI

SEQ ID NO: 19752 - protein, 469 aa, Artificial Sequence; identical to SEQ ID NO: 16599
  neuraminidase__InfluenzaA__ADM95711

SEQ ID NO: 19753 - protein, 469 aa, Artificial Sequence; identical to SEQ ID NO: 16599
  neuraminidase__InfluenzaA__ADM95712

SEQ ID NO: 19754 - protein, 469 aa, Artificial Sequence; identical to SEQ ID NO: 16599
  neuraminidase__InfluenzaA__ADM95713

SEQ ID NO: 19755 - protein, 469 aa, Artificial Sequence
  neuraminidase__InfluenzaA__ADM95714
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETDVLWTSNSIVVFCGTSGTYGTGSWPDGADINLMPI

SEQ ID NO: 19756 - protein, 469 aa, Artificial Sequence; identical to SEQ ID NO: 16599
  neuraminidase__InfluenzaA__ADM95715

SEQ ID NO: 19757 - protein, 469 aa, Artificial Sequence; identical to SEQ ID NO: 19755
  neuraminidase__InfluenzaA__ADM95716

SEQ ID NO: 19758 - protein, 469 aa, Artificial Sequence; identical to SEQ ID NO: 19755
  neuraminidase__InfluenzaA__ADM95717

SEQ ID NO: 19759 - protein, 469 aa, Artificial Sequence; identical to SEQ ID NO: 16599
  neuraminidase__InfluenzaA__ADM95718

SEQ ID NO: 19760 - protein, 469 aa, Artificial Sequence
  neuraminidase__InfluenzaA__ADM95719
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRSGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19761 - protein, 469 aa, Artificial Sequence; identical to SEQ ID NO: 16599
  neuraminidase__InfluenzaA__ADM95720

SEQ ID NO: 19762 - protein, 469 aa, Artificial Sequence; identical to SEQ ID NO: 16599
  neuraminidase__InfluenzaA__ADM95721

SEQ ID NO: 19763 - protein, 469 aa, Artificial Sequence; identical to SEQ ID NO: 16599
  neuraminidase__InfluenzaA__ADM95723

SEQ ID NO: 19764 - protein, 469 aa, Artificial Sequence
  neuraminidase__InfluenzaA__ADM95724
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 19765 - protein, 469 aa, Artificial Sequence
  neuraminidase__InfluenzaA__ADM95725
MNPNQKIITIGSVSLTISTICFFMQIAILITTVTLHFKQYEFNPPPNNQVMLCEPTIIERNITEIVYLTNTTIEKEVCPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVITDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETDVLWTSNSIVVFCGTSGTYGTGSWPDGADINLMPI

SEQ ID NO: 19766 - protein, 469 aa, Artificial Sequence
  neuraminidase__InfluenzaA__ADM95726
MNPNQKIITIGSVSLTISTICFFMQIAILITAVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETDVLWTSNSIVVFCGTSGTYGTGSWPDGADINLMPI

SEQ ID NO: 19767 - protein, 469 aa, Artificial Sequence; identical to SEQ ID NO: 16599
  neuraminidase__InfluenzaA__ADM95727

SEQ ID NO: 19768 - protein, 469 aa, Artificial Sequence
  neuraminidase__InfluenzaA__ADM95728
MNPNQKIITIGSVSLTISTICFFMQIAILITTVTLHFKQYEFNSPPNNQVMLCEPTIIERNITEIVYLTNTTIEKEICPELAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19769 - protein, 469 aa, Artificial Sequence
  neuraminidase__InfluenzaA__ADM95729
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSRSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19770 - protein, 469 aa, Artificial Sequence
  neuraminidase__InfluenzaA__ADM95730
MNPNQKIITIGSVSLTISTICFFMQIAILITTVTLHFKQYEFNSPPSNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19771 - protein, 469 aa, Artificial Sequence
  neuraminidase__InfluenzaA__ADM95732
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDRSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADINLMPI

SEQ ID NO: 19772 - protein, 469 aa, Artificial Sequence; identical to SEQ ID NO: 16599
  neuraminidase__InfluenzaA__ADM95733

SEQ ID NO: 19773 - protein, 469 aa, Artificial Sequence; identical to SEQ ID NO: 16599
  neuraminidase__InfluenzaA__ADM95734

SEQ ID NO: 19774 - protein, 469 aa, Artificial Sequence; identical to SEQ ID NO: 16599
  neuraminidase__InfluenzaA__ADM95735

SEQ ID NO: 19775 - protein, 469 aa, Artificial Sequence; identical to SEQ ID NO: 16599
  neuraminidase__InfluenzaA__ADM95736

SEQ ID NO: 19776 - protein, 469 aa, Artificial Sequence
  neuraminidase__InfluenzaA__ADM95737
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGRADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETDVLWTSNSIVVFCGTSGTYGTGSWPDGADINLMPI

SEQ ID NO: 19777 - protein, 469 aa, Artificial Sequence; identical to SEQ ID NO: 16599
  neuraminidase__InfluenzaA__ADM95738

SEQ ID NO: 19778 - protein, 469 aa, Artificial Sequence; identical to SEQ ID NO: 16599
  neuraminidase__InfluenzaA__ADM95739

SEQ ID NO: 19779 - protein, 469 aa, Artificial Sequence
  neuraminidase__InfluenzaA__ADM95740
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNDEEGGHGVKGWAFDDGNDVWMGRTISEKSRLGYETFKVIEGWSNPKSKLQINRQVIVDRGNRSGYSGIFSVEGKSCINRCFYVELIRGRKEETKVLWTSNSIVVFCGTSGTYGTGSWPDGADINLMPI

SEQ ID NO: 19780 - protein, 469 aa, Artificial Sequence; identical to SEQ ID NO: 19755
  neuraminidase__InfluenzaA__ADM95741

SEQ ID NO: 19781 - protein, 469 aa, Artificial Sequence; identical to SEQ ID NO: 16599
  neuraminidase__InfluenzaA__ADM95742

SEQ ID NO: 19782 - protein, 469 aa, Artificial Sequence
  neuraminidase__InfluenzaA__ADM95743
MNPNQKIITIGSVSLTISTICFFMQIAILITTVTLHFKQYEFNSSPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 19783 - protein, 469 aa, Artificial Sequence; identical to SEQ ID NO: 16599
  neuraminidase__InfluenzaA__ADM95744

SEQ ID NO: 19784 - protein, 469 aa, Artificial Sequence; identical to SEQ ID NO: 16738
  neuraminidase__InfluenzaA__ADN05229

SEQ ID NO: 19785 - protein, 470 aa, Artificial Sequence; identical to SEQ ID NO: 17461
  neuraminidase__InfluenzaA__ADN06292

SEQ ID NO: 19786 - protein, 470 aa, Artificial Sequence; identical to SEQ ID NO: 18930
  neuraminidase__InfluenzaA__ADN06303

SEQ ID NO: 19787 - protein, 470 aa, Artificial Sequence
  neuraminidase__InfluenzaA__ADN06314
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGEVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNGDTANWSWPDGAELPFTIDK

SEQ ID NO: 19788 - protein, 470 aa, Artificial Sequence; identical to SEQ ID NO: 18930
  neuraminidase__InfluenzaA__ADN06325

SEQ ID NO: 19789 - protein, 470 aa, Artificial Sequence
  neuraminidase__InfluenzaA__ADN06347
MNPNQKIITIGSISIAIGIISLMLQIGNIISIWASHSIQTESQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQMGYICSGVFGDNPRPEDGEGSCNPVNVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19790 - protein, 469 aa, Artificial Sequence; identical to SEQ ID NO: 19410
  neuraminidase__InfluenzaA__ADN06369

SEQ ID NO: 19791 - protein, 469 aa, Artificial Sequence; identical to SEQ ID NO: 16738
  neuraminidase__InfluenzaA__ADN26031

SEQ ID NO: 19792 - protein, 469 aa, Artificial Sequence; identical to SEQ ID NO: 16738
  neuraminidase__InfluenzaA__ADN26032

SEQ ID NO: 19793 - protein, 469 aa, Artificial Sequence; identical to SEQ ID NO: 16738
  neuraminidase__InfluenzaA__ADN26033

SEQ ID NO: 19794 - protein, 469 aa, Artificial Sequence; identical to SEQ ID NO: 16738
  neuraminidase__InfluenzaA__ADN26034

SEQ ID NO: 19795 - protein, 469 aa, Artificial Sequence; identical to SEQ ID NO: 16738
  neuraminidase__InfluenzaA__ADN26035

SEQ ID NO: 19796 - protein, 469 aa, Artificial Sequence; identical to SEQ ID NO: 16738
  neuraminidase__InfluenzaA__ADN26036

SEQ ID NO: 19797 - protein, 469 aa, Artificial Sequence
  neuraminidase__InfluenzaA__ADN26037
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPIDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19798 - protein, 469 aa, Artificial Sequence; identical to SEQ ID NO: 16738
  neuraminidase__InfluenzaA__ADN26038

SEQ ID NO: 19799 - protein, 469 aa, Artificial Sequence; identical to SEQ ID NO: 16738
  neuraminidase__InfluenzaA__ADN26041

SEQ ID NO: 19800 - protein, 469 aa, Artificial Sequence; identical to SEQ ID NO: 16738
  neuraminidase__InfluenzaA__ADN26042

SEQ ID NO: 19801 - protein, 469 aa, Artificial Sequence
  neuraminidase__InfluenzaA__ADN26043
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQVGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19802 - protein, 469 aa, Artificial Sequence; identical to SEQ ID NO: 16738
  neuraminidase__InfluenzaA__ADN26044

SEQ ID NO: 19803 - protein, 469 aa, Artificial Sequence; identical to SEQ ID NO: 16738
  neuraminidase__InfluenzaA__ADN26045

SEQ ID NO: 19804 - protein, 469 aa, Artificial Sequence
  neuraminidase__InfluenzaA__ADN26047
MNPNQKIITIGSVCMTIGMANLILQIGNIISIWISHSIQLGNQNQIETCNQSVITYENNTWVNQTYVNISNTNFAAGQSMVSVKLTGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19805 - protein, 469 aa, Artificial Sequence; identical to SEQ ID NO: 16738
  neuraminidase__InfluenzaA__ADN26048

SEQ ID NO: 19806 - protein, 469 aa, Artificial Sequence; identical to SEQ ID NO: 16738
  neuraminidase__InfluenzaA__ADN26049

SEQ ID NO: 19807 - protein, 469 aa, Artificial Sequence; identical to SEQ ID NO: 16738
  neuraminidase__InfluenzaA__ADN26050

SEQ ID NO: 19808 - protein, 469 aa, Artificial Sequence; identical to SEQ ID NO: 16738
  neuraminidase__InfluenzaA__ADN26051

SEQ ID NO: 19809 - protein, 469 aa, Artificial Sequence; identical to SEQ ID NO: 16738
  neuraminidase__InfluenzaA__ADN26052

SEQ ID NO: 19810 - protein, 469 aa, Artificial Sequence; identical to SEQ ID NO: 16728
  neuraminidase__InfluenzaA__ADN26053

SEQ ID NO: 19811 - protein, 469 aa, Artificial Sequence; identical to SEQ ID NO: 16738
  neuraminidase__InfluenzaA__ADN26054

SEQ ID NO: 19812 - protein, 469 aa, Artificial Sequence; identical to SEQ ID NO: 16738
  neuraminidase__InfluenzaA__ADN26057

SEQ ID NO: 19813 - protein, 469 aa, Artificial Sequence; identical to SEQ ID NO: 16738
  neuraminidase__InfluenzaA__ADN26058

SEQ ID NO: 19814 - protein, 469 aa, Artificial Sequence; identical to SEQ ID NO: 16738
  neuraminidase__InfluenzaA__ADN26059

SEQ ID NO: 19815 - protein, 469 aa, Artificial Sequence; identical to SEQ ID NO: 17105
  neuraminidase__InfluenzaA__ADN26060

SEQ ID NO: 19816 - protein, 469 aa, Artificial Sequence; identical to SEQ ID NO: 16738
  neuraminidase__InfluenzaA__ADN26061

SEQ ID NO: 19817 - protein, 469 aa, Artificial Sequence; identical to SEQ ID NO: 16738
  neuraminidase__InfluenzaA__ADN26063

SEQ ID NO: 19818 - protein, 469 aa, Artificial Sequence; identical to SEQ ID NO: 16738
  neuraminidase__InfluenzaA__ADN26064

SEQ ID NO: 19819 - protein, 469 aa, Artificial Sequence; identical to SEQ ID NO: 17811
  neuraminidase__InfluenzaA__ADN26065

SEQ ID NO: 19820 - protein, 469 aa, Artificial Sequence; identical to SEQ ID NO: 16738
  neuraminidase__InfluenzaA__ADN26066

SEQ ID NO: 19821 - protein, 469 aa, Artificial Sequence; identical to SEQ ID NO: 16738
  neuraminidase__InfluenzaA__ADN26067

SEQ ID NO: 19822 - protein, 469 aa, Artificial Sequence; identical to SEQ ID NO: 16738
  neuraminidase__InfluenzaA__ADN26069

SEQ ID NO: 19823 - protein, 469 aa, Artificial Sequence; identical to SEQ ID NO: 16738
  neuraminidase__InfluenzaA__ADN26070

SEQ ID NO: 19824 - protein, 469 aa, Artificial Sequence; identical to SEQ ID NO: 16738
  neuraminidase__InfluenzaA__ADN26072

SEQ ID NO: 19825 - protein, 469 aa, Artificial Sequence; identical to SEQ ID NO: 16738
  neuraminidase__InfluenzaA__ADN26073

SEQ ID NO: 19826 - protein, 469 aa, Artificial Sequence; identical to SEQ ID NO: 16738
  neuraminidase__InfluenzaA__ADN26075

SEQ ID NO: 19827 - protein, 469 aa, Artificial Sequence; identical to SEQ ID NO: 16738
  neuraminidase__InfluenzaA__ADN26076

SEQ ID NO: 19828 - protein, 469 aa, Artificial Sequence; identical to SEQ ID NO: 16738
  neuraminidase__InfluenzaA__ADN26077

SEQ ID NO: 19829 - protein, 469 aa, Artificial Sequence; identical to SEQ ID NO: 16738
  neuraminidase__InfluenzaA__ADN26078

SEQ ID NO: 19830 - protein, 469 aa, Artificial Sequence; identical to SEQ ID NO: 16738
  neuraminidase__InfluenzaA__ADN26079

SEQ ID NO: 19831 - protein, 469 aa, Artificial Sequence; identical to SEQ ID NO: 16738
  neuraminidase__InfluenzaA__ADN26080

SEQ ID NO: 19832 - protein, 469 aa, Artificial Sequence; identical to SEQ ID NO: 16738
  neuraminidase__InfluenzaA__ADN26081

SEQ ID NO: 19833 - protein, 469 aa, Artificial Sequence; identical to SEQ ID NO: 16738
  neuraminidase__InfluenzaA__ADN26082

SEQ ID NO: 19834 - protein, 469 aa, Artificial Sequence; identical to SEQ ID NO: 16738
  neuraminidase__InfluenzaA__ADN26083

SEQ ID NO: 19835 - protein, 469 aa, Artificial Sequence; identical to SEQ ID NO: 18640
  neuraminidase__InfluenzaA__ADN26084

SEQ ID NO: 19836 - protein, 469 aa, Artificial Sequence; identical to SEQ ID NO: 16738
  neuraminidase__InfluenzaA__ADN26085

SEQ ID NO: 19837 - protein, 469 aa, Artificial Sequence; identical to SEQ ID NO: 16738
  neuraminidase__InfluenzaA__ADN26086

SEQ ID NO: 19838 - protein, 469 aa, Artificial Sequence; identical to SEQ ID NO: 16738
  neuraminidase__InfluenzaA__ADN26087

SEQ ID NO: 19839 - protein, 469 aa, Artificial Sequence; identical to SEQ ID NO: 16738
  neuraminidase__InfluenzaA__ADN26088

SEQ ID NO: 19840 - protein, 469 aa, Artificial Sequence; identical to SEQ ID NO: 16738
  neuraminidase__InfluenzaA__ADN26090

SEQ ID NO: 19841 - protein, 469 aa, Artificial Sequence; identical to SEQ ID NO: 16738
  neuraminidase__InfluenzaA__ADN26091

SEQ ID NO: 19842 - protein, 469 aa, Artificial Sequence; identical to SEQ ID NO: 16738
  neuraminidase__InfluenzaA__ADN26092

SEQ ID NO: 19843 - protein, 469 aa, Artificial Sequence; identical to SEQ ID NO: 16738
  neuraminidase__InfluenzaA__ADN26093

SEQ ID NO: 19844 - protein, 469 aa, Artificial Sequence
  neuraminidase__InfluenzaA__ADN26094
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGKDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19845 - protein, 469 aa, Artificial Sequence; identical to SEQ ID NO: 18640
  neuraminidase__InfluenzaA__ADN26095

SEQ ID NO: 19846 - protein, 469 aa, Artificial Sequence
  neuraminidase__InfluenzaA__ADN26096
MNPNQKIITIGSVCMTIGMANLILQIGNIISIWISHSIQLGNQNQIETCNQSVITYENNTWVNQTYVNISNTNFAAGQSVVSVKLAGNSSLCPVNGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKNISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19847 - protein, 469 aa, Artificial Sequence; identical to SEQ ID NO: 16738
  neuraminidase__InfluenzaA__ADN26097

SEQ ID NO: 19848 - protein, 469 aa, Artificial Sequence; identical to SEQ ID NO: 16738
  neuraminidase__InfluenzaA__ADN26098

SEQ ID NO: 19849 - protein, 469 aa, Artificial Sequence; identical to SEQ ID NO: 16738
  neuraminidase__InfluenzaA__ADN26099

SEQ ID NO: 19850 - protein, 469 aa, Artificial Sequence; identical to SEQ ID NO: 16738
  neuraminidase__InfluenzaA__ADN26100

SEQ ID NO: 19851 - protein, 469 aa, Artificial Sequence; identical to SEQ ID NO: 16738
  neuraminidase__InfluenzaA__ADN26101

SEQ ID NO: 19852 - protein, 469 aa, Artificial Sequence
  neuraminidase__InfluenzaA__ADN26102
MNPNQKIITIGSVCMTIGMANLILQIGNIISIWISHLIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENSIWTSGSSISFCGVNSDTVGWSWPDGAELPFTIDK

SEQ ID NO: 19853 - protein, 469 aa, Artificial Sequence; identical to SEQ ID NO: 16738
  neuraminidase__InfluenzaA__ADN26103

SEQ ID NO: 19854 - protein, 469 aa, Artificial Sequence; identical to SEQ ID NO: 16738
  neuraminidase__InfluenzaA__ADN26104

SEQ ID NO: 19855 - protein, 469 aa, Artificial Sequence; identical to SEQ ID NO: 16738
  neuraminidase__InfluenzaA__ADN26105

SEQ ID NO: 19856 - protein, 469 aa, Artificial Sequence; identical to SEQ ID NO: 16738
  neuraminidase__InfluenzaA__ADN26106

SEQ ID NO: 19857 - protein, 469 aa, Artificial Sequence; identical to SEQ ID NO: 18640
  neuraminidase__InfluenzaA__ADN26107

SEQ ID NO: 19858 - protein, 469 aa, Artificial Sequence; identical to SEQ ID NO: 18640
  neuraminidase__InfluenzaA__ADN26108

SEQ ID NO: 19859 - protein, 469 aa, Artificial Sequence; identical to SEQ ID NO: 16738
  neuraminidase__InfluenzaA__ADN26109

SEQ ID NO: 19860 - protein, 469 aa, Artificial Sequence; identical to SEQ ID NO: 17712
  neuraminidase__InfluenzaA__ADN26110

SEQ ID NO: 19861 - protein, 469 aa, Artificial Sequence; identical to SEQ ID NO: 18640
  neuraminidase__InfluenzaA__ADN26111

SEQ ID NO: 19862 - protein, 469 aa, Artificial Sequence; identical to SEQ ID NO: 17712
  neuraminidase__InfluenzaA__ADN26112

SEQ ID NO: 19863 - protein, 469 aa, Artificial Sequence; identical to SEQ ID NO: 18640
  neuraminidase__InfluenzaA__ADN26113

SEQ ID NO: 19864 - protein, 469 aa, Artificial Sequence
  neuraminidase__InfluenzaA__ADN26114
MNPNQKIITIGSVCMTIGMANLILQIGNIISIWISHSIQLGNQNQIETCNQSVITYENNTWVNQTYVNINNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19865 - protein, 469 aa, Artificial Sequence; identical to SEQ ID NO: 16738
  neuraminidase__InfluenzaA__ADN26115

SEQ ID NO: 19866 - protein, 469 aa, Artificial Sequence
  neuraminidase__InfluenzaA__ADN26116
MNPNQKIITIGSVCMTIGMANLILQIGNIISIWISHSIQLGNQNQIETCNQSVITYENNTWVNQTYVNISNTNFAAGQSVVSVKLAGNSSLCPVNGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTRLDCIRPCFWVELIRGRPKENTIWTSGSSISFCGVNSDTVGWSWPDGAELPFTIDK

SEQ ID NO: 19867 - protein, 469 aa, Artificial Sequence; identical to SEQ ID NO: 18640
  neuraminidase__InfluenzaA__ADN26117

SEQ ID NO: 19868 - protein, 469 aa, Artificial Sequence; identical to SEQ ID NO: 18640
  neuraminidase__InfluenzaA__ADN26118

SEQ ID NO: 19869 - protein, 469 aa, Artificial Sequence; identical to SEQ ID NO: 16738
  neuraminidase__InfluenzaA__ADN26119

SEQ ID NO: 19870 - protein, 469 aa, Artificial Sequence; identical to SEQ ID NO: 17712
  neuraminidase__InfluenzaA__ADN26120

SEQ ID NO: 19871 - protein, 469 aa, Artificial Sequence; identical to SEQ ID NO: 18640
  neuraminidase__InfluenzaA__ADN26121

SEQ ID NO: 19872 - protein, 469 aa, Artificial Sequence; identical to SEQ ID NO: 16738
  neuraminidase__InfluenzaA__ADN26122

SEQ ID NO: 19873 - protein, 469 aa, Artificial Sequence; identical to SEQ ID NO: 16738
  neuraminidase__InfluenzaA__ADN26123

SEQ ID NO: 19874 - protein, 469 aa, Artificial Sequence; identical to SEQ ID NO: 16738
  neuraminidase__InfluenzaA__ADN26124

SEQ ID NO: 19875 - protein, 469 aa, Artificial Sequence; identical to SEQ ID NO: 17712
  neuraminidase__InfluenzaA__ADN26125

SEQ ID NO: 19876 - protein, 469 aa, Artificial Sequence; identical to SEQ ID NO: 17712
  neuraminidase__InfluenzaA__ADN26126

SEQ ID NO: 19877 - protein, 469 aa, Artificial Sequence; identical to SEQ ID NO: 17503
  neuraminidase__InfluenzaA__ADN26127

SEQ ID NO: 19878 - protein, 469 aa, Artificial Sequence; identical to SEQ ID NO: 16738
  neuraminidase__InfluenzaA__ADN26128

SEQ ID NO: 19879 - protein, 469 aa, Artificial Sequence; identical to SEQ ID NO: 17712
  neuraminidase__InfluenzaA__ADN26129

SEQ ID NO: 19880 - protein, 469 aa, Artificial Sequence; identical to SEQ ID NO: 18640
  neuraminidase__InfluenzaA__ADN26130

SEQ ID NO: 19881 - protein, 469 aa, Artificial Sequence
  neuraminidase__InfluenzaA__ADN26131
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISLCGVNSDTVGWSWPDGAELPFTIDK

SEQ ID NO: 19882 - protein, 469 aa, Artificial Sequence; identical to SEQ ID NO: 18640
  neuraminidase__InfluenzaA__ADN26132

SEQ ID NO: 19883 - protein, 469 aa, Artificial Sequence; identical to SEQ ID NO: 17712
  neuraminidase__InfluenzaA__ADN26134

SEQ ID NO: 19884 - protein, 469 aa, Artificial Sequence; identical to SEQ ID NO: 16738
  neuraminidase__InfluenzaA__ADN26135

SEQ ID NO: 19885 - protein, 469 aa, Artificial Sequence; identical to SEQ ID NO: 16738
  neuraminidase__InfluenzaA__ADN26136

SEQ ID NO: 19886 - protein, 469 aa, Artificial Sequence; identical to SEQ ID NO: 16738
  neuraminidase__InfluenzaA__ADN26137

SEQ ID NO: 19887 - protein, 469 aa, Artificial Sequence; identical to SEQ ID NO: 18640
  neuraminidase__InfluenzaA__ADN26138

SEQ ID NO: 19888 - protein, 469 aa, Artificial Sequence; identical to SEQ ID NO: 17712
  neuraminidase__InfluenzaA__ADN26140

SEQ ID NO: 19889 - protein, 469 aa, Artificial Sequence
  neuraminidase__InfluenzaA__ADN26141
MNPNQKIITIGSVCMTIGMANLILQIGNIISIWISHSIQLGNQNRIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19890 - protein, 469 aa, Artificial Sequence
  neuraminidase__InfluenzaA__ADN26142
MNPNQKIITIGSVCMTIGMANLILQIGNIISIWISHSIQLGNQNQIETCNQSVITYENNTWVNQTYVNISNNNFAAGQSVVSVKLAGNSSLCPVNGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19891 - protein, 469 aa, Artificial Sequence; identical to SEQ ID NO: 16738
  neuraminidase__InfluenzaA__ADN26143

SEQ ID NO: 19892 - protein, 469 aa, Artificial Sequence; identical to SEQ ID NO: 18640
  neuraminidase__InfluenzaA__ADN26144

SEQ ID NO: 19893 - protein, 469 aa, Artificial Sequence; identical to SEQ ID NO: 18640
  neuraminidase__InfluenzaA__ADN26145

SEQ ID NO: 19894 - protein, 469 aa, Artificial Sequence; identical to SEQ ID NO: 16738
  neuraminidase__InfluenzaA__ADN26146

SEQ ID NO: 19895 - protein, 469 aa, Artificial Sequence; identical to SEQ ID NO: 18640
  neuraminidase__InfluenzaA__ADN26147

SEQ ID NO: 19896 - protein, 469 aa, Artificial Sequence; identical to SEQ ID NO: 16738
  neuraminidase__InfluenzaA__ADN26148

SEQ ID NO: 19897 - protein, 469 aa, Artificial Sequence; identical to SEQ ID NO: 18640
  neuraminidase__InfluenzaA__ADN26149

SEQ ID NO: 19898 - protein, 469 aa, Artificial Sequence
  neuraminidase__InfluenzaA__ADN26150
MNPNQKIITIGSVCMTIGMASLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19899 - protein, 469 aa, Artificial Sequence; identical to SEQ ID NO: 17712
  neuraminidase__InfluenzaA__ADN26151

SEQ ID NO: 19900 - protein, 469 aa, Artificial Sequence
  neuraminidase__InfluenzaA__ADN26152
MNPNQKIITIGSVCMTIGMANLILQIGNIISIWISHSIQLGNQNQIETCNQSVITYENNTWVNQTYVNISNTNFAAGQSVVSMKLAGNSSLCPVNGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTRTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19901 - protein, 469 aa, Artificial Sequence; identical to SEQ ID NO: 18640
  neuraminidase__InfluenzaA__ADN26153

SEQ ID NO: 19902 - protein, 469 aa, Artificial Sequence; identical to SEQ ID NO: 17321
  neuraminidase__InfluenzaA__ADN26154

SEQ ID NO: 19903 - protein, 469 aa, Artificial Sequence; identical to SEQ ID NO: 16738
  neuraminidase__InfluenzaA__ADN26155

SEQ ID NO: 19904 - protein, 469 aa, Artificial Sequence; identical to SEQ ID NO: 17712
  neuraminidase__InfluenzaA__ADN26157

SEQ ID NO: 19905 - protein, 469 aa, Artificial Sequence; identical to SEQ ID NO: 16738
  neuraminidase__InfluenzaA__ADN26159

SEQ ID NO: 19906 - protein, 469 aa, Artificial Sequence; identical to SEQ ID NO: 16738
  neuraminidase__InfluenzaA__ADN26161

SEQ ID NO: 19907 - protein, 469 aa, Artificial Sequence
  neuraminidase__InfluenzaA__ADN26162
MNPNQKIITISSVCMTVGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19908 - protein, 469 aa, Artificial Sequence
  neuraminidase__InfluenzaA__ADN26163
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFIIDK

SEQ ID NO: 19909 - protein, 469 aa, Artificial Sequence
  neuraminidase__InfluenzaA__ADN26164
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACLNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNDFSIKQDIVGINEWSGYSGSFVQHPELTGLDCIRPCFWVELIRGRPKENTIWTSGSSISFCGVNSDTVGWSWPDGAELPFTIDK

SEQ ID NO: 19910 - protein, 469 aa, Artificial Sequence; identical to SEQ ID NO: 18695
  neuraminidase__InfluenzaA__ADN26168

SEQ ID NO: 19911 - protein, 469 aa, Artificial Sequence; identical to SEQ ID NO: 17961
  neuraminidase__InfluenzaA__ADN26178

SEQ ID NO: 19912 - protein, 469 aa, Artificial Sequence; identical to SEQ ID NO: 16738
  neuraminidase__InfluenzaA__ADN26868

SEQ ID NO: 19913 - protein, 469 aa, Artificial Sequence; identical to SEQ ID NO: 16738
  neuraminidase__InfluenzaA__ADN26869

SEQ ID NO: 19914 - protein, 469 aa, Artificial Sequence; identical to SEQ ID NO: 16738
  neuraminidase__InfluenzaA__ADN26870

SEQ ID NO: 19915 - protein, 469 aa, Artificial Sequence
  neuraminidase__InfluenzaA__ADN26871
MNPNQKIITIGSVCMTIGMANLILQIGNIISIWISHSIQLGNQNQIETYNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19916 - protein, 469 aa, Artificial Sequence
  neuraminidase__InfluenzaA__ADN26872
MNPNQKIITIGSVCMTIGMANLILQIGNIISIWISHSIQLGNQNQIETCNQSVITYENNTWVNQTYVNISNTNFAAGLSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 19917 - protein, 469 aa, Artificial Sequence; identical to SEQ ID NO: 16738
  neuraminidase__InfluenzaA__ADN26873

SEQ ID NO: 19918 - protein, 469 aa, Artificial Sequence; identical to SEQ ID NO: 16738
  neuraminidase__InfluenzaA__ADN26874

SEQ ID NO: 19919 - protein, 469 aa, Artificial Sequence; identical to SEQ ID NO: 16738
  neuraminidase__InfluenzaA__ADN26875

SEQ ID NO: 19920 - protein, 469 aa, Artificial Sequence; identical to SEQ ID NO: 16738
  neuraminidase__InfluenzaA__ADN26876

SEQ ID NO: 19921 - protein, 469 aa, Artificial Sequence; identical to SEQ ID NO: 16738
  neuraminidase__InfluenzaA__ADN26877

SEQ ID NO: 19922 - protein, 469 aa, Artificial Sequence; identical to SEQ ID NO: 16738
  neuraminidase__InfluenzaA__ADN26878

SEQ ID NO: 19923 - protein, 469 aa, Artificial Sequence; identical to SEQ ID NO: 17875
  neuraminidase__InfluenzaA__ADN26879

SEQ ID NO: 19924 - protein, 469 aa, Artificial Sequence; identical to SEQ ID NO: 16738
  neuraminidase__InfluenzaA__ADN26880

SEQ ID NO: 19925 - protein, 469 aa, Artificial Sequence; identical to SEQ ID NO: 16738
  neuraminidase__InfluenzaA__ADN26881

SEQ ID NO: 19926 - protein, 469 aa, Artificial Sequence; identical to SEQ ID NO: 16738
  neuraminidase__InfluenzaA__ADN26882

SEQ ID NO: 19927 - protein, 469 aa, Artificial Sequence; identical to SEQ ID NO: 16738
  neuraminidase__InfluenzaA__ADN26883

SEQ ID NO: 19928 - protein, 470 aa, Artificial Sequence
  neuraminidase__InfluenzaA__ADN89064
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRRGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19929 - protein, 470 aa, Artificial Sequence; identical to SEQ ID NO: 17461
  neuraminidase__InfluenzaA__ADN89075

SEQ ID NO: 19930 - protein, 470 aa, Artificial Sequence
  neuraminidase__InfluenzaA__ADN89086
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKTASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19931 - protein, 470 aa, Artificial Sequence; identical to SEQ ID NO: 17461
  neuraminidase__InfluenzaA__ADN89097

SEQ ID NO: 19932 - protein, 470 aa, Artificial Sequence
  neuraminidase__InfluenzaA__ADN89108
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVSITDWSGYSGSFVQHPELTGLDCIRPCFWVELVRGLPRENTTIWTSGSSISFCGVNSDTANWSWPDGAELPFTIDK

SEQ ID NO: 19933 - protein, 470 aa, Artificial Sequence
  neuraminidase__InfluenzaA__ADN89119
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVNGADGVKGFSYKYGNGVWIGRTKSNRLRKGFEMIWDPNGWTNTDSDFSVKQDVVAITDWSGYSGSFVQHPELTGLDCTRPCFWVELVRGLPRENTTIWTSGSSISFCGVNSDTANWSWPDGAELPFTIDK

SEQ ID NO: 19934 - protein, 470 aa, Artificial Sequence
  neuraminidase__InfluenzaA__ADN89130
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSNFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNGDTANWSWPDGAELPFTIDK

SEQ ID NO: 19935 - protein, 470 aa, Artificial Sequence; identical to SEQ ID NO: 19932
  neuraminidase__InfluenzaA__ADN89141

SEQ ID NO: 19936 - protein, 470 aa, Artificial Sequence
  neuraminidase__InfluenzaA__ADN89152
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTIDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19937 - protein, 470 aa, Artificial Sequence
  neuraminidase__InfluenzaA__ADN89163
MNPNQRIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19938 - protein, 470 aa, Artificial Sequence; identical to SEQ ID NO: 18930
  neuraminidase__InfluenzaA__ADN89174

SEQ ID NO: 19939 - protein, 470 aa, Artificial Sequence; identical to SEQ ID NO: 19932
  neuraminidase__InfluenzaA__ADN89185

SEQ ID NO: 19940 - protein, 470 aa, Artificial Sequence
  neuraminidase__InfluenzaA__ADN89196
MNPNQKIITIGSISIAIGIISLMLQIGSIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQMGYICSGVFGDNPRPEDGEGSCNPVTVDGANGVKGFSYKYGNGVWIGRTKSNRLRKGFEMIWDPNGWTNTDSDFSLKQDVVAITDWSGYSGSFVQHPELTGLDCIRPCFWVELVRGLPRENTTIWTSGSSISFCGVNSDTANWSWPDGAELPFTIDK

SEQ ID NO: 19941 - protein, 470 aa, Artificial Sequence; identical to SEQ ID NO: 19940
  neuraminidase__InfluenzaA__ADN89207

SEQ ID NO: 19942 - protein, 470 aa, Artificial Sequence
  neuraminidase__InfluenzaA__ADN89218
MNPNQKIITIGSISIAIGIISLMLQIGNIISIWASHSIQPGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNGDTANWSWPDGAELPFTIDK

SEQ ID NO: 19943 - protein, 470 aa, Artificial Sequence
  neuraminidase__InfluenzaA__ADN89229
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVATTDWSGYSGSFVQHPELTGLDCIRPCFWVELVRGLPRENTTIWTSGSSISFCGVNSDTANWSWPDGAELPFTIDK

SEQ ID NO: 19944 - protein, 470 aa, Artificial Sequence
  neuraminidase__InfluenzaA__ADN89240
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNGDTANWSWPDGAELPFTIDK

SEQ ID NO: 19945 - protein, 470 aa, Artificial Sequence; identical to SEQ ID NO: 17461
  neuraminidase__InfluenzaA__ADN89251

SEQ ID NO: 19946 - protein, 470 aa, Artificial Sequence; identical to SEQ ID NO: 17461
  neuraminidase__InfluenzaA__ADN89262

SEQ ID NO: 19947 - protein, 470 aa, Artificial Sequence; identical to SEQ ID NO: 17461
  neuraminidase__InfluenzaA__ADN89273

SEQ ID NO: 19948 - protein, 470 aa, Artificial Sequence; identical to SEQ ID NO: 17461
  neuraminidase__InfluenzaA__ADN89284

SEQ ID NO: 19949 - protein, 470 aa, Artificial Sequence; identical to SEQ ID NO: 17461
  neuraminidase__InfluenzaA__ADN89295

SEQ ID NO: 19950 - protein, 470 aa, Artificial Sequence; identical to SEQ ID NO: 17461
  neuraminidase__InfluenzaA__ADN89306

SEQ ID NO: 19951 - protein, 470 aa, Artificial Sequence
  neuraminidase__InfluenzaA__ADN89317
MNPNQRIITIGSISIAIGIISLMLQIGNIISIWASHSIQTGSQNNTGICNQRIITYENSTWVNHTYVNINSTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNGDTANWSWPDGAELPFTIDK

SEQ ID NO: 19952 - protein, 470 aa, Artificial Sequence
  neuraminidase__InfluenzaA__ADN89328
MNPNQKIITIGSISIAIGIISLMLQIGSIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWASGSSISFCGVNSDTANWSWPDGAELPFTIDK

SEQ ID NO: 19953 - protein, 470 aa, Artificial Sequence; identical to SEQ ID NO: 19937
  neuraminidase__InfluenzaA__ADN89339

SEQ ID NO: 19954 - protein, 470 aa, Artificial Sequence; identical to SEQ ID NO: 19943
  neuraminidase__InfluenzaA__ADN89350

SEQ ID NO: 19955 - protein, 470 aa, Artificial Sequence
  neuraminidase__InfluenzaA__ADN89361
MNPNQKIITIGSISIAIGIISLMLQIGSIISIWASHSIQTGSQNNTGICNQRIITYENSTWVNHTYVNINNTNVVAGEDKTSVTLAGNSSLCSISGWAIYTKDNSIRIGSKGDVFIIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19956 - protein, 470 aa, Artificial Sequence
  neuraminidase__InfluenzaA__ADN89372
MNPNQKIITIGSISIAIGIISLMLQIGNIISIWASHSIQTGSQNNTGICNQRIITYENSTWVNHTYVNINNTNIVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVNGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19957 - protein, 470 aa, Artificial Sequence; identical to SEQ ID NO: 19932
  neuraminidase__InfluenzaA__ADN89383

SEQ ID NO: 19958 - protein, 470 aa, Artificial Sequence
  neuraminidase__InfluenzaA__ADN89405
MNPNQKIITIGSISIAIGIISLMLQIGSIISIWASHSIQTGSQNNTGICNQRIITYENSTWVNHTYVNINNTNVVAGEDKTSVTLAGNSSLCSTSGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19959 - protein, 470 aa, Artificial Sequence
  neuraminidase__InfluenzaA__ADN89416
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVLGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNGDTANWSWPDGAELPFTIDK

SEQ ID NO: 19960 - protein, 470 aa, Artificial Sequence
  neuraminidase__InfluenzaA__ADN89427
MNPNQKIITIGSISIAIGIISLMLQIGSIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVDSDAADWSWPDGAELPFTIDK

SEQ ID NO: 19961 - protein, 470 aa, Artificial Sequence; identical to SEQ ID NO: 17461
  neuraminidase__InfluenzaA__ADN89438

SEQ ID NO: 19962 - protein, 470 aa, Artificial Sequence
  neuraminidase__InfluenzaA__ADN89449
MNPNQKIITIGSISIAIGIISLMLQIGNIISIWASHSIQTGSQNNTGICNQRIITYENSTWVNHTYVNINNTNVVAGEDKPSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19963 - protein, 470 aa, Artificial Sequence; identical to SEQ ID NO: 18930
  neuraminidase__InfluenzaA__ADN89460

SEQ ID NO: 19964 - protein, 470 aa, Artificial Sequence; identical to SEQ ID NO: 17461
  neuraminidase__InfluenzaA__ADN89482

SEQ ID NO: 19965 - protein, 470 aa, Artificial Sequence
  neuraminidase__InfluenzaA__ADN89493
MNPNQKIITIGSISIAIGIISLMLQIGNIISIWASHSIQTESQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQMGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19966 - protein, 470 aa, Artificial Sequence; identical to SEQ ID NO: 17461
  neuraminidase__InfluenzaA__ADN89504

SEQ ID NO: 19967 - protein, 470 aa, Artificial Sequence
  neuraminidase__InfluenzaA__ADN89515
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFTVKQDVVAITDWSGYSGSFVQHPELTGLDCIRPCFWVELVRGLPRENTTIWTSGSSISFCGVNSDTANWSWPDGAELPFTIDK

SEQ ID NO: 19968 - protein, 470 aa, Artificial Sequence; identical to SEQ ID NO: 17461
  neuraminidase__InfluenzaA__ADN89526

SEQ ID NO: 19969 - protein, 470 aa, Artificial Sequence; identical to SEQ ID NO: 19932
  neuraminidase__InfluenzaA__ADN89537

SEQ ID NO: 19970 - protein, 470 aa, Artificial Sequence; identical to SEQ ID NO: 17461
  neuraminidase__InfluenzaA__ADN89548

SEQ ID NO: 19971 - protein, 470 aa, Artificial Sequence; identical to SEQ ID NO: 17461
  neuraminidase__InfluenzaA__ADN89570

SEQ ID NO: 19972 - protein, 470 aa, Artificial Sequence
  neuraminidase__InfluenzaA__ADN89581
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKTASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNGDTANWSWPDGAELPFTIDK

SEQ ID NO: 19973 - protein, 470 aa, Artificial Sequence; identical to SEQ ID NO: 18930
  neuraminidase__InfluenzaA__ADN89592

SEQ ID NO: 19974 - protein, 470 aa, Artificial Sequence; identical to SEQ ID NO: 18930
  neuraminidase__InfluenzaA__ADN89603

SEQ ID NO: 19975 - protein, 470 aa, Artificial Sequence; identical to SEQ ID NO: 19940
  neuraminidase__InfluenzaA__ADN89614

SEQ ID NO: 19976 - protein, 470 aa, Artificial Sequence; identical to SEQ ID NO: 19959
  neuraminidase__InfluenzaA__ADN89625

SEQ ID NO: 19977 - protein, 470 aa, Artificial Sequence; identical to SEQ ID NO: 17461
  neuraminidase__InfluenzaA__ADN89636

SEQ ID NO: 19978 - protein, 470 aa, Artificial Sequence; identical to SEQ ID NO: 17461
  neuraminidase__InfluenzaA__ADN89647

SEQ ID NO: 19979 - protein, 470 aa, Artificial Sequence; identical to SEQ ID NO: 17461
  neuraminidase__InfluenzaA__ADN89658

SEQ ID NO: 19980 - protein, 470 aa, Artificial Sequence; identical to SEQ ID NO: 18930
  neuraminidase__InfluenzaA__ADN89669

SEQ ID NO: 19981 - protein, 470 aa, Artificial Sequence; identical to SEQ ID NO: 17461
  neuraminidase__InfluenzaA__ADN89680

SEQ ID NO: 19982 - protein, 470 aa, Artificial Sequence; identical to SEQ ID NO: 17461
  neuraminidase__InfluenzaA__ADN89691

SEQ ID NO: 19983 - protein, 470 aa, Artificial Sequence; identical to SEQ ID NO: 19959
  neuraminidase__InfluenzaA__ADN89702

SEQ ID NO: 19984 - protein, 470 aa, Artificial Sequence; identical to SEQ ID NO: 17461
  neuraminidase__InfluenzaA__ADN89713

SEQ ID NO: 19985 - protein, 470 aa, Artificial Sequence; identical to SEQ ID NO: 17461
  neuraminidase__InfluenzaA__ADN89724

SEQ ID NO: 19986 - protein, 470 aa, Artificial Sequence; identical to SEQ ID NO: 17461
  neuraminidase__InfluenzaA__ADN89735

SEQ ID NO: 19987 - protein, 470 aa, Artificial Sequence; identical to SEQ ID NO: 17461
  neuraminidase__InfluenzaA__ADN89746

SEQ ID NO: 19988 - protein, 470 aa, Artificial Sequence; identical to SEQ ID NO: 17461
  neuraminidase__InfluenzaA__ADN89757

SEQ ID NO: 19989 - protein, 470 aa, Artificial Sequence; identical to SEQ ID NO: 17461
  neuraminidase__InfluenzaA__ADN89768

SEQ ID NO: 19990 - protein, 470 aa, Artificial Sequence; identical to SEQ ID NO: 19936
  neuraminidase__InfluenzaA__ADN89779

SEQ ID NO: 19991 - protein, 470 aa, Artificial Sequence; identical to SEQ ID NO: 17461
  neuraminidase__InfluenzaA__ADN89790

SEQ ID NO: 19992 - protein, 470 aa, Artificial Sequence
  neuraminidase__InfluenzaA__ADN89801
MNPNQKIITIGSISIAIGTISLMLQIGNIISIWASHSIQTGSQNNTGICNQRIITYKNSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19993 - protein, 470 aa, Artificial Sequence
  neuraminidase__InfluenzaA__ADN89823
MNPNQKIITIGSISIAIGIISLMLQIGSIISIWASHSIHTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 19994 - protein, 470 aa, Artificial Sequence; identical to SEQ ID NO: 18930
  neuraminidase__InfluenzaA__ADN89834

SEQ ID NO: 19995 - protein, 470 aa, Artificial Sequence; identical to SEQ ID NO: 19932
  neuraminidase__InfluenzaA__ADN89845

SEQ ID NO: 19996 - protein, 470 aa, Artificial Sequence; identical to SEQ ID NO: 17461
  neuraminidase__InfluenzaA__ADN89856

SEQ ID NO: 19997 - protein, 469 aa, Artificial Sequence; identical to SEQ ID NO: 19410
  neuraminidase__InfluenzaA__ADN89867

SEQ ID NO: 19998 - protein, 469 aa, Artificial Sequence; identical to SEQ ID NO: 19410
  neuraminidase__InfluenzaA__ADN89878

SEQ ID NO: 19999 - protein, 469 aa, Artificial Sequence; identical to SEQ ID NO: 19410
  neuraminidase__InfluenzaA__ADN89889

SEQ ID NO: 20000 - protein, 469 aa, Artificial Sequence; identical to SEQ ID NO: 19410
  neuraminidase__InfluenzaA__ADN89900

SEQ ID NO: 20001 - protein, 469 aa, Artificial Sequence; identical to SEQ ID NO: 19410
  neuraminidase__InfluenzaA__ADN89911

SEQ ID NO: 20002 - protein, 469 aa, Artificial Sequence
  neuraminidase__InfluenzaA__ADN89922
MNPNQKIITIGSVSLTISTICFFMQIAILITTVTLHFKQYKFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNIMPI

SEQ ID NO: 20003 - protein, 469 aa, Artificial Sequence; identical to SEQ ID NO: 19410
  neuraminidase__InfluenzaA__ADN89933

SEQ ID NO: 20004 - protein, 469 aa, Artificial Sequence; identical to SEQ ID NO: 19410
  neuraminidase__InfluenzaA__ADN89955

SEQ ID NO: 20005 - protein, 469 aa, Artificial Sequence; identical to SEQ ID NO: 19410
  neuraminidase__InfluenzaA__ADN89966

SEQ ID NO: 20006 - protein, 469 aa, Artificial Sequence; identical to SEQ ID NO: 19410
  neuraminidase__InfluenzaA__ADN89977

SEQ ID NO: 20007 - protein, 469 aa, Artificial Sequence; identical to SEQ ID NO: 19410
  neuraminidase__InfluenzaA__ADN89988

SEQ ID NO: 20008 - protein, 469 aa, Artificial Sequence; identical to SEQ ID NO: 19410
  neuraminidase__InfluenzaA__ADN89999

SEQ ID NO: 20009 - protein, 469 aa, Artificial Sequence; identical to SEQ ID NO: 19410
  neuraminidase__InfluenzaA__ADN90010

SEQ ID NO: 20010 - protein, 469 aa, Artificial Sequence; identical to SEQ ID NO: 19410
  neuraminidase__InfluenzaA__ADN90021

SEQ ID NO: 20011 - protein, 469 aa, Artificial Sequence; identical to SEQ ID NO: 19410
  neuraminidase__InfluenzaA__ADN90032

SEQ ID NO: 20012 - protein, 469 aa, Artificial Sequence; identical to SEQ ID NO: 19410
  neuraminidase__InfluenzaA__ADN90043

SEQ ID NO: 20013 - protein, 469 aa, Artificial Sequence; identical to SEQ ID NO: 19410
  neuraminidase__InfluenzaA__ADN90054

SEQ ID NO: 20014 - protein, 469 aa, Artificial Sequence; identical to SEQ ID NO: 19410
  neuraminidase__InfluenzaA__ADN90065

SEQ ID NO: 20015 - protein, 469 aa, Artificial Sequence; identical to SEQ ID NO: 19410
  neuraminidase__InfluenzaA__ADN90076

SEQ ID NO: 20016 - protein, 469 aa, Artificial Sequence; identical to SEQ ID NO: 19410
  neuraminidase__InfluenzaA__ADN90087

SEQ ID NO: 20017 - protein, 469 aa, Artificial Sequence; identical to SEQ ID NO: 19410
  neuraminidase__InfluenzaA__ADN90098

SEQ ID NO: 20018 - protein, 469 aa, Artificial Sequence; identical to SEQ ID NO: 19410
  neuraminidase__InfluenzaA__ADN90109

SEQ ID NO: 20019 - protein, 469 aa, Artificial Sequence; identical to SEQ ID NO: 19410
  neuraminidase__InfluenzaA__ADN90120

SEQ ID NO: 20020 - protein, 469 aa, Artificial Sequence; identical to SEQ ID NO: 19410
  neuraminidase__InfluenzaA__ADN90131

SEQ ID NO: 20021 - protein, 469 aa, Artificial Sequence; identical to SEQ ID NO: 19410
  neuraminidase__InfluenzaA__ADN90142

SEQ ID NO: 20022 - protein, 469 aa, Artificial Sequence; identical to SEQ ID NO: 19410
  neuraminidase__InfluenzaA__ADN90153

SEQ ID NO: 20023 - protein, 469 aa, Artificial Sequence; identical to SEQ ID NO: 19410
  neuraminidase__InfluenzaA__ADN90164

SEQ ID NO: 20024 - protein, 469 aa, Artificial Sequence; identical to SEQ ID NO: 19410
  neuraminidase__InfluenzaA__ADN90186

SEQ ID NO: 20025 - protein, 469 aa, Artificial Sequence; identical to SEQ ID NO: 19410
  neuraminidase__InfluenzaA__ADN90197

SEQ ID NO: 20026 - protein, 469 aa, Artificial Sequence
  neuraminidase__InfluenzaA__ADN90208
MNPNQKIITIGSVSLTISTICFFMQIAILITTVTLHFKQYKFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSNRSGYSGIFSVEGKSCINRCFYVELIRGRKEETEVLWTSNSIVVFCGTSGTYGTGSWPDGADLNLMPI

SEQ ID NO: 20027 - protein, 469 aa, Artificial Sequence; identical to SEQ ID NO: 19410
  neuraminidase__InfluenzaA__ADN90219

SEQ ID NO: 20028 - protein, 469 aa, Artificial Sequence
  neuraminidase__InfluenzaA__ADN92469
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASEKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20029 - protein, 469 aa, Artificial Sequence; identical to SEQ ID NO: 19255
  neuraminidase__InfluenzaA__ADN92480

SEQ ID NO: 20030 - protein, 469 aa, Artificial Sequence; identical to SEQ ID NO: 19255
  neuraminidase__InfluenzaA__ADN92491

SEQ ID NO: 20031 - protein, 469 aa, Artificial Sequence
  neuraminidase__InfluenzaA__ADN92502
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGNGVKGWAFDDGNDVWMGRTISEKSRLGYETFKVIEGWSNPKSKLQINRQVIVDRGNRSGYSGIFSVEGKSCINRCFYVELIRGRKEENEVLWTSNSIVVFCGTSGTYGTGSWPDGADINLMPI

SEQ ID NO: 20032 - protein, 469 aa, Artificial Sequence; identical to SEQ ID NO: 16738
  neuraminidase__InfluenzaA__ADN92512

SEQ ID NO: 20033 - protein, 469 aa, Artificial Sequence; identical to SEQ ID NO: 16738
  neuraminidase__InfluenzaA__ADN92522

SEQ ID NO: 20034 - protein, 469 aa, Artificial Sequence; identical to SEQ ID NO: 16738
  neuraminidase__InfluenzaA__ADN92532

SEQ ID NO: 20035 - protein, 469 aa, Artificial Sequence; identical to SEQ ID NO: 16738
  neuraminidase__InfluenzaA__ADN92542

SEQ ID NO: 20036 - protein, 469 aa, Artificial Sequence; identical to SEQ ID NO: 16738
  neuraminidase__InfluenzaA__ADN92552

SEQ ID NO: 20037 - protein, 469 aa, Artificial Sequence; identical to SEQ ID NO: 16738
  neuraminidase__InfluenzaA__ADO00733

SEQ ID NO: 20038 - protein, 469 aa, Artificial Sequence
  neuraminidase__InfluenzaA__ADO00743
MNPNQKIITIGSVCMTIGMANLILQIGNIISIWISHSIQLGNQNQIETCNQSVITYENNTWVNQTYVNISNTNFAAGQSVVSAKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIRQDIVGINEWSGYSGSFVQHPELTGLDCIRPCFWVELIRGRPKENTIWTSGSSISFCGVNSDTVGWSWPDGAELPFTIDK

SEQ ID NO: 20039 - protein, 469 aa, Artificial Sequence; identical to SEQ ID NO: 17915
  neuraminidase__InfluenzaA__ADO00753

SEQ ID NO: 20040 - protein, 469 aa, Artificial Sequence; identical to SEQ ID NO: 16738
  neuraminidase__InfluenzaA__ADO12146

SEQ ID NO: 20041 - protein, 469 aa, Artificial Sequence; identical to SEQ ID NO: 16738
  neuraminidase__InfluenzaA__ADO12156

SEQ ID NO: 20042 - protein, 469 aa, Artificial Sequence; identical to SEQ ID NO: 16738
  neuraminidase__InfluenzaA__ADO12166

SEQ ID NO: 20043 - protein, 469 aa, Artificial Sequence; identical to SEQ ID NO: 16738
  neuraminidase__InfluenzaA__ADO12176

SEQ ID NO: 20044 - protein, 469 aa, Artificial Sequence; identical to SEQ ID NO: 16738
  neuraminidase__InfluenzaA__ADO12186

SEQ ID NO: 20045 - protein, 469 aa, Artificial Sequence; identical to SEQ ID NO: 16738
  neuraminidase__InfluenzaA__ADO12196

SEQ ID NO: 20046 - protein, 469 aa, Artificial Sequence; identical to SEQ ID NO: 16738
  neuraminidase__InfluenzaA__ADO12206

SEQ ID NO: 20047 - protein, 469 aa, Artificial Sequence; identical to SEQ ID NO: 16738
  neuraminidase__InfluenzaA__ADO12216

SEQ ID NO: 20048 - protein, 469 aa, Artificial Sequence; identical to SEQ ID NO: 16738
  neuraminidase__InfluenzaA__ADO12226

SEQ ID NO: 20049 - protein, 469 aa, Artificial Sequence; identical to SEQ ID NO: 16738
  neuraminidase__InfluenzaA__ADO12246

SEQ ID NO: 20050 - protein, 469 aa, Artificial Sequence; identical to SEQ ID NO: 16738
  neuraminidase__InfluenzaA__ADO12266

SEQ ID NO: 20051 - protein, 469 aa, Artificial Sequence
  neuraminidase__InfluenzaA__ADO12276
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKSGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20052 - protein, 469 aa, Artificial Sequence; identical to SEQ ID NO: 16738
  neuraminidase__InfluenzaA__ADO12286

SEQ ID NO: 20053 - protein, 469 aa, Artificial Sequence; identical to SEQ ID NO: 16738
  neuraminidase__InfluenzaA__ADO12296

SEQ ID NO: 20054 - protein, 469 aa, Artificial Sequence; identical to SEQ ID NO: 16738
  neuraminidase__InfluenzaA__ADO12306

SEQ ID NO: 20055 - protein, 469 aa, Artificial Sequence
  neuraminidase__InfluenzaA__ADO12316
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGDGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20056 - protein, 469 aa, Artificial Sequence; identical to SEQ ID NO: 16738
  neuraminidase__InfluenzaA__ADO12326

SEQ ID NO: 20057 - protein, 469 aa, Artificial Sequence; identical to SEQ ID NO: 16738
  neuraminidase__InfluenzaA__ADO12336

SEQ ID NO: 20058 - protein, 469 aa, Artificial Sequence; identical to SEQ ID NO: 16738
  neuraminidase__InfluenzaA__ADO12346

SEQ ID NO: 20059 - protein, 469 aa, Artificial Sequence; identical to SEQ ID NO: 16738
  neuraminidase__InfluenzaA__ADO12356

SEQ ID NO: 20060 - protein, 469 aa, Artificial Sequence; identical to SEQ ID NO: 16738
  neuraminidase__InfluenzaA__ADO12366

SEQ ID NO: 20061 - protein, 469 aa, Artificial Sequence; identical to SEQ ID NO: 16738
  neuraminidase__InfluenzaA__ADO12376

SEQ ID NO: 20062 - protein, 469 aa, Artificial Sequence; identical to SEQ ID NO: 16738
  neuraminidase__InfluenzaA__ADO12386

SEQ ID NO: 20063 - protein, 469 aa, Artificial Sequence; identical to SEQ ID NO: 16738
  neuraminidase__InfluenzaA__ADO12396

SEQ ID NO: 20064 - protein, 469 aa, Artificial Sequence; identical to SEQ ID NO: 16738
  neuraminidase__InfluenzaA__ADO12406

SEQ ID NO: 20065 - protein, 469 aa, Artificial Sequence; identical to SEQ ID NO: 17505
  neuraminidase__InfluenzaA__ADO12416

SEQ ID NO: 20066 - protein, 469 aa, Artificial Sequence; identical to SEQ ID NO: 16738
  neuraminidase__InfluenzaA__ADO12426

SEQ ID NO: 20067 - protein, 469 aa, Artificial Sequence; identical to SEQ ID NO: 16738
  neuraminidase__InfluenzaA__ADO12436

SEQ ID NO: 20068 - protein, 469 aa, Artificial Sequence; identical to SEQ ID NO: 16738
  neuraminidase__InfluenzaA__ADO12446

SEQ ID NO: 20069 - protein, 469 aa, Artificial Sequence; identical to SEQ ID NO: 16738
  neuraminidase__InfluenzaA__ADO12456

SEQ ID NO: 20070 - protein, 469 aa, Artificial Sequence; identical to SEQ ID NO: 16738
  neuraminidase__InfluenzaA__ADO12466

SEQ ID NO: 20071 - protein, 469 aa, Artificial Sequence; identical to SEQ ID NO: 16738
  neuraminidase__InfluenzaA__ADO12476

SEQ ID NO: 20072 - protein, 469 aa, Artificial Sequence; identical to SEQ ID NO: 16738
  neuraminidase__InfluenzaA__ADO12486

SEQ ID NO: 20073 - protein, 469 aa, Artificial Sequence; identical to SEQ ID NO: 16738
  neuraminidase__InfluenzaA__ADO12496

SEQ ID NO: 20074 - protein, 469 aa, Artificial Sequence; identical to SEQ ID NO: 16738
  neuraminidase__InfluenzaA__ADO12506

SEQ ID NO: 20075 - protein, 469 aa, Artificial Sequence; identical to SEQ ID NO: 16738
  neuraminidase__InfluenzaA__ADO12516

SEQ ID NO: 20076 - protein, 469 aa, Artificial Sequence; identical to SEQ ID NO: 16738
  neuraminidase__InfluenzaA__ADO12526

SEQ ID NO: 20077 - protein, 469 aa, Artificial Sequence; identical to SEQ ID NO: 16738
  neuraminidase__InfluenzaA__ADO12536

SEQ ID NO: 20078 - protein, 469 aa, Artificial Sequence; identical to SEQ ID NO: 16738
  neuraminidase__InfluenzaA__ADO12546

SEQ ID NO: 20079 - protein, 469 aa, Artificial Sequence; identical to SEQ ID NO: 16738
  neuraminidase__InfluenzaA__ADO12556

SEQ ID NO: 20080 - protein, 469 aa, Artificial Sequence; identical to SEQ ID NO: 16738
  neuraminidase__InfluenzaA__ADO12566

SEQ ID NO: 20081 - protein, 469 aa, Artificial Sequence; identical to SEQ ID NO: 16738
  neuraminidase__InfluenzaA__ADO12576

SEQ ID NO: 20082 - protein, 469 aa, Artificial Sequence
  neuraminidase__InfluenzaA__ADO12586
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20083 - protein, 469 aa, Artificial Sequence; identical to SEQ ID NO: 20082
  neuraminidase__InfluenzaA__ADO12596

SEQ ID NO: 20084 - protein, 469 aa, Artificial Sequence; identical to SEQ ID NO: 16738
  neuraminidase__InfluenzaA__ADO12606

SEQ ID NO: 20085 - protein, 469 aa, Artificial Sequence; identical to SEQ ID NO: 16738
  neuraminidase__InfluenzaA__ADO12616

SEQ ID NO: 20086 - protein, 469 aa, Artificial Sequence; identical to SEQ ID NO: 16738
  neuraminidase__InfluenzaA__ADO12626

SEQ ID NO: 20087 - protein, 469 aa, Artificial Sequence; identical to SEQ ID NO: 16738
  neuraminidase__InfluenzaA__ADO14355

SEQ ID NO: 20088 - protein, 466 aa, Artificial Sequence
  neuraminidase__InfluenzaA__ADO21028
MNPNQKIIAIGSVSLTIATICFLMQIAILATTMTLHFKQNECSNPSNNQVVPCEPTIIERNIVHLNSTTIEKEICPKVAEYKNWSKPQCQITGSAPFSKGNSIRLSAGGDIWVTREPYVSCSLGKCYQFALGQGTTLKNKHSNGTTHDRVPHRTLLMSELGVPFHLGTKQVCIAWSSSSCHDGKAWLHVCVTGDDKNATASIIYDGMLVDSIGSWSKNILRTQESECVCINGTCTVVMTDGSASGKADTRILFIREGKIVHISPLSGSAQHVEECSCYPRYPEVRCVCRDNWKGSNRPVLYINMADYSIESSYVCSGLVGDTPRNDDSYSSSNCRDPNNERGAPGVKGWAFDNGNDIWMGRTIKEDSRSGYETFRVVGGWTTANSKSQINRQVIVDSDNWSGYSGIFSVEGKNCINRCFYVELIRGRPQETRVWWTSNSIIVFCGTSGTYGTGSWPDGANINFMPI

SEQ ID NO: 20089 - protein, 466 aa, Artificial Sequence
  neuraminidase__InfluenzaA__ADO21039
MNPNQKIIAIGSVSLTIATICFLMQIAILATTMTLHFKQNECSNPSNNQVVPCEPTIIERNIVHLNSTTIEKEICPKVAEYKNWSKPQCQITGSAPFSKGNSIRLSAGGDIWVTREPYVSCSLGKCYQFALGQGTTLKNKHSNGTTHDRDPHRTLLMSELGVPFHLGTKQVCIAWSSSSCHDGKAWLHVCVTGDDKNATASIIYDGMLVDSIGSWSKNILRTQESECVCINGTCTVVMTDGSASGKADTRILFIREGKIVHISPLSGSAQHVEECSCYPRYPEVRCVCRDNWKGSNRPVLYINMADYTIESSYVCSGLVGDTPRNDDSYSSSNCRDPNNERGAPGVKGWAFDNGNDIWMGRTIKEDSRSGYETFRVVGGWTTANSKSQINRQVIVDSDNWSGYSGIFSVEGKNCINRCFYVELIRGRPQETRVWWTSNSIIVFCGTSGTYGTGSWPDGANINFMPI

SEQ ID NO: 20090 - protein, 466 aa, Artificial Sequence
  neuraminidase__InfluenzaA__ADO21050
MNPNQKIIAIGSVSLTIATICFLMQIAILATTMTLHFKQNECSNPSNNQVVPCEPTIIERNIVHLNSTTIEKEICPKVAEYKNWSKPQCQITGSAPFSKGNSIRLSAGGDIWVTREPYVSCSLGKCYQFALGQGTTLKNKHSNGTTHDRGPHRTLLMSELGVPFHLGTKQVCIAWSSSSCHDGKAWLHVCVTGDDKNATASIIYDGMLVDSIGSWSKNILRTQESECVCINGTCTVVMTDGSASGKADTRILFIREGKIVHISPLSGSAQHVEECSCYPRYPEVRCVCRDNWKGSNRPVLYINMADYSIESSYVCSGLVGDTPRNDDSYSSSNCRDPNNESGAPGVKGWAFDNGNDIWMGRTIKEDSRSGYETFRVVGGWTTANSKSQINRQVIVDSDNWSGYSGIFSVEGKNCINRCFYVELIRGRPQETRVWWTSNSIIVFCGTSGTYGTGSWPDGANINFMPI

SEQ ID NO: 20091 - protein, 469 aa, Artificial Sequence
  neuraminidase__InfluenzaA__ADO25095
MNPNQKIITIGSVCMTIGMANLILQIGNIISIWISHSIQLGNQNQIETCNQSIITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRSGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20092 - protein, 469 aa, Artificial Sequence
  neuraminidase__InfluenzaA__ADO25105
MNPNQKIITIGSVCMTIGMANLILQIGNIISIWISHSIQLGNQNQIGTCNQSVITYETNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDRQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20093 - protein, 469 aa, Artificial Sequence; identical to SEQ ID NO: 18519
  neuraminidase__InfluenzaA__ADO25115

SEQ ID NO: 20094 - protein, 469 aa, Artificial Sequence; identical to SEQ ID NO: 18519
  neuraminidase__InfluenzaA__ADO25125

SEQ ID NO: 20095 - protein, 469 aa, Artificial Sequence
  neuraminidase__InfluenzaA__ADO25135
MNPNQKIITIGSVCMTIGMANLVLQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20096 - protein, 469 aa, Artificial Sequence; identical to SEQ ID NO: 18089
  neuraminidase__InfluenzaA__ADO25145

SEQ ID NO: 20097 - protein, 469 aa, Artificial Sequence; identical to SEQ ID NO: 16738
  neuraminidase__InfluenzaA__ADO25155

SEQ ID NO: 20098 - protein, 469 aa, Artificial Sequence; identical to SEQ ID NO: 16738
  neuraminidase__InfluenzaA__ADO25165

SEQ ID NO: 20099 - protein, 469 aa, Artificial Sequence; identical to SEQ ID NO: 16738
  neuraminidase__InfluenzaA__ADO25175

SEQ ID NO: 20100 - protein, 469 aa, Artificial Sequence
  neuraminidase__InfluenzaA__ADO25185
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSMSSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20101 - protein, 469 aa, Artificial Sequence; identical to SEQ ID NO: 19167
  neuraminidase__InfluenzaA__ADO25195

SEQ ID NO: 20102 - protein, 469 aa, Artificial Sequence; identical to SEQ ID NO: 17875
  neuraminidase__InfluenzaA__ADO25205

SEQ ID NO: 20103 - protein, 469 aa, Artificial Sequence; identical to SEQ ID NO: 18089
  neuraminidase__InfluenzaA__ADO25215

SEQ ID NO: 20104 - protein, 469 aa, Artificial Sequence; identical to SEQ ID NO: 16738
  neuraminidase__InfluenzaA__ADO25225

SEQ ID NO: 20105 - protein, 469 aa, Artificial Sequence; identical to SEQ ID NO: 18089
  neuraminidase__InfluenzaA__ADO25235

SEQ ID NO: 20106 - protein, 469 aa, Artificial Sequence; identical to SEQ ID NO: 16738
  neuraminidase__InfluenzaA__ADO25245

SEQ ID NO: 20107 - protein, 469 aa, Artificial Sequence; identical to SEQ ID NO: 16738
  neuraminidase__InfluenzaA__ADO25255

SEQ ID NO: 20108 - protein, 469 aa, Artificial Sequence; identical to SEQ ID NO: 18519
  neuraminidase__InfluenzaA__ADO25265

SEQ ID NO: 20109 - protein, 469 aa, Artificial Sequence; identical to SEQ ID NO: 18330
  neuraminidase__InfluenzaA__ADO25275

SEQ ID NO: 20110 - protein, 469 aa, Artificial Sequence; identical to SEQ ID NO: 18089
  neuraminidase__InfluenzaA__ADO25285

SEQ ID NO: 20111 - protein, 470 aa, Artificial Sequence
  neuraminidase__InfluenzaA__ADO27623
MNPNQKIITIGSISIAIGIISLMLQIGNIISIWASHSIQTGSQNNTGICNQRIITYENSTWVNHTYVNINNTNVAAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20112 - protein, 469 aa, Artificial Sequence; identical to SEQ ID NO: 16738
  neuraminidase__InfluenzaA__ADO30410

SEQ ID NO: 20113 - protein, 469 aa, Artificial Sequence; identical to SEQ ID NO: 18089
  neuraminidase__InfluenzaA__ADO30420

SEQ ID NO: 20114 - protein, 469 aa, Artificial Sequence; identical to SEQ ID NO: 17446
  neuraminidase__InfluenzaA__ADP95343

SEQ ID NO: 20115 - protein, 469 aa, Artificial Sequence; identical to SEQ ID NO: 16728
  neuraminidase__InfluenzaA__ADP95353

SEQ ID NO: 20116 - protein, 469 aa, Artificial Sequence; identical to SEQ ID NO: 16728
  neuraminidase__InfluenzaA__ADP95363

SEQ ID NO: 20117 - protein, 469 aa, Artificial Sequence; identical to SEQ ID NO: 16728
  neuraminidase__InfluenzaA__ADP95373

SEQ ID NO: 20118 - protein, 469 aa, Artificial Sequence; identical to SEQ ID NO: 16728
  neuraminidase__InfluenzaA__ADP95383

SEQ ID NO: 20119 - protein, 469 aa, Artificial Sequence; identical to SEQ ID NO: 16728
  neuraminidase__InfluenzaA__ADP95393

SEQ ID NO: 20120 - protein, 469 aa, Artificial Sequence
  neuraminidase__InfluenzaA__ADQ43774
MNPNQKIITIGSGCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMKAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20121 - protein, 469 aa, Artificial Sequence
  neuraminidase__InfluenzaA__ADQ92578
MNPNQKIITIGSVSLTISTICFFMQIAILITTVTLHFKQYEFNSPPNNQVILCEPTIIERNITEIVYLTNATIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20122 - protein, 469 aa, Artificial Sequence; identical to SEQ ID NO: 16599
  neuraminidase__InfluenzaA__ADR32364

SEQ ID NO: 20123 - protein, 469 aa, Artificial Sequence
  neuraminidase__InfluenzaA__ADT64478
MNPNQKIITIGSVCMTIGMANLILQIGNIISIWIGHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20124 - protein, 469 aa, Artificial Sequence
  neuraminidase__InfluenzaA__ADT78889
MNPNQKIITIGSVSLTIATVCFLMQIAILVTTVTLHFKQHECDSPASNQVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCVAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRDPNNERGNPGVKGWAFDNGDDVWMGRTISKDLRSGYETFKVIGGWSTPNSKSQINRQVIVDSNNWSGYSGIFSVEGKSCINRCFYVELIRGRQQETRVWWTSNSIVVFCGTSGTYGTGSWPDGANISFMPI

SEQ ID NO: 20125 - protein, 469 aa, Artificial Sequence
  neuraminidase__InfluenzaA__ADT78899
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVMREPYVSCNPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRPQETRVWWTSSSIVVFCGTSGTYGTGSWPDGANINFMPI

SEQ ID NO: 20126 - protein, 469 aa, Artificial Sequence
  neuraminidase__InfluenzaA__ADT78963
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHVEECSCYPRYPDVRCICRDNWKGSNRPVIDINMEDYSIDSSYVCSGLVGDTPRNDDRSSNSNCRDPNNERGNPGVKGWAFDNGNDVWMGRTISKDLRSGYETFKVIGGWSTPNSKSQVNRQVIVDNNNWSGYSGIFSVEGKSCINRCFYVELIRGRQQETRVWWTSNSIVVFCGTSGTYGTGSWPDGANINFMPI

SEQ ID NO: 20127 - protein, 469 aa, Artificial Sequence
  neuraminidase__InfluenzaA__ADT79001
MNPNQKIITIGSISLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGKADTRILFIEEGKIVHISPLSGSAQHVEECSCYPRYPGVRCICRDNWKGSNRPVVDINVKDYSIDSSYVCSGLVGDTPRNNDRSSSSYCRNPNNERGNHGVKGWAFDDGNDVWMGRTISKDSRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 20128 - protein, 469 aa, Artificial Sequence; identical to SEQ ID NO: 14118
  neuraminidase__InfluenzaA__ADT79021

SEQ ID NO: 20129 - protein, 469 aa, Artificial Sequence
  neuraminidase__InfluenzaA__ADT79041
MNPNQKIITIGSVSLTIATVCFLMQIAILVTTVTLHFRQYECDSPANNQVMPCEPIIIERNITEIVYLNNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVEDYSIDSSYVCSGLVGDTPRNNDRSSNSNCRNPNNERGNHGVKGWAFDDGNDVWMGRTISKDLRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 20130 - protein, 469 aa, Artificial Sequence; identical to SEQ ID NO: 15760
  neuraminidase__InfluenzaA__ADT79121

SEQ ID NO: 20131 - protein, 469 aa, Artificial Sequence
  neuraminidase__InfluenzaA__ADT79131
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLEDSIGSWSQNILRTQESECVCINGTCTVVMTDGSASGRADTRILFIKEGKIVHISPLSGSAQHIEECSCYPRYPDVRCICRDNWKGSNRPVLDISMEDYSIDSSYVCSGLVGDTPRNDDSSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRSQETRVWWTSNSIVVFCGTSGTYGTGSWPDGANINFMPI

SEQ ID NO: 20132 - protein, 469 aa, Artificial Sequence; identical to SEQ ID NO: 16738
  neuraminidase__InfluenzaA__ADT79234

SEQ ID NO: 20133 - protein, 469 aa, Artificial Sequence; identical to SEQ ID NO: 16728
  neuraminidase__InfluenzaA__ADT79244

SEQ ID NO: 20134 - protein, 469 aa, Artificial Sequence
  neuraminidase__InfluenzaA__ADU25480
MNPNQKIIIISSICLINGITSLILQIGNIISIWISHSIQIGNQNQTETCSQNIITYENNTWVNQTYVNISNNNFVAEQAVVSMKLAGSSPLCPVSGWAIYSKDNSVRIGSKGDVFVIREPFISCSHLECRTFFLTQGALLNDKHSNGTIKDRSPYRTLMSCPIGEVPSPYNSRFESVAWSASACHDGTSWLTIGISGPDNGAVAVLKYNDIITDTIKSWRNNILRTQESECVCVNGSCFTVMTDGPSNGQASYKIFKIEKGKVVKSVELNAPNYHYEECSCYPDSGEIICVCRDNWHGSNRPWVSFNQNLEYQIGYICSGILGDNPRPNDRTGSCGPVSLNGANGVKGFSFKYGNGVWIGRTKSSSSRSGFEMIWDPNGWTETDNNFLVKQDIVGMTDWSGYSGSFVQHPELTGMNCMRPCFWVELIRGRPKENTIWTSGSSISFCGVNSDTVDWSWPDGAELPFTIDK

SEQ ID NO: 20135 - protein, 469 aa, Artificial Sequence; identical to SEQ ID NO: 16738
  neuraminidase__InfluenzaA__ADU59780

SEQ ID NO: 20136 - protein, 469 aa, Artificial Sequence
  neuraminidase__InfluenzaA__ADU59789
MNPNQKIITIGSVCMTIGMANLILQIGNIISIWISHSIQLGNQNQIETCNQSVITYENNTWVNQTYVNVSNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20137 - protein, 469 aa, Artificial Sequence; identical to SEQ ID NO: 16738
  neuraminidase__InfluenzaA__ADU59829

SEQ ID NO: 20138 - protein, 469 aa, Artificial Sequence
  neuraminidase__InfluenzaA__ADU59838
MNPNQKIIIIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHFEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVDWSWPDGAELPFTIDK

SEQ ID NO: 20139 - protein, 469 aa, Artificial Sequence; identical to SEQ ID NO: 18089
  neuraminidase__InfluenzaA__ADU59847

SEQ ID NO: 20140 - protein, 469 aa, Artificial Sequence; identical to SEQ ID NO: 16738
  neuraminidase__InfluenzaA__ADU59907

SEQ ID NO: 20141 - protein, 469 aa, Artificial Sequence; identical to SEQ ID NO: 16738
  neuraminidase__InfluenzaA__ADU59917

SEQ ID NO: 20142 - protein, 469 aa, Artificial Sequence; identical to SEQ ID NO: 16738
  neuraminidase__InfluenzaA__ADU59920

SEQ ID NO: 20143 - protein, 469 aa, Artificial Sequence; identical to SEQ ID NO: 16738
  neuraminidase__InfluenzaA__ADU59941

SEQ ID NO: 20144 - protein, 469 aa, Artificial Sequence
  neuraminidase__InfluenzaA__ADU76311
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAKLPFTIDK

SEQ ID NO: 20145 - protein, 469 aa, Artificial Sequence
  neuraminidase__InfluenzaA__ADU76313
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAKLPFTIDK

SEQ ID NO: 20146 - protein, 469 aa, Artificial Sequence; identical to SEQ ID NO: 20145
  neuraminidase__InfluenzaA__ADU76314

SEQ ID NO: 20147 - protein, 469 aa, Artificial Sequence; identical to SEQ ID NO: 20145
  neuraminidase__InfluenzaA__ADU76315

SEQ ID NO: 20148 - protein, 469 aa, Artificial Sequence; identical to SEQ ID NO: 20145
  neuraminidase__InfluenzaA__ADU76316

SEQ ID NO: 20149 - protein, 469 aa, Artificial Sequence
  neuraminidase__InfluenzaA__ADU76317
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSTSSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20150 - protein, 469 aa, Artificial Sequence
  neuraminidase__InfluenzaA__ADU76318
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNHNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20151 - protein, 469 aa, Artificial Sequence; identical to SEQ ID NO: 17981
  neuraminidase__InfluenzaA__ADU76319

SEQ ID NO: 20152 - protein, 469 aa, Artificial Sequence; identical to SEQ ID NO: 16738
  neuraminidase__InfluenzaA__ADU76320

SEQ ID NO: 20153 - protein, 469 aa, Artificial Sequence; identical to SEQ ID NO: 16738
  neuraminidase__InfluenzaA__ADU76321

SEQ ID NO: 20154 - protein, 469 aa, Artificial Sequence
  neuraminidase__InfluenzaA__ADU76322
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKVVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSIISFCGVNSDTVGWSWPDGAELPFTIDK

SEQ ID NO: 20155 - protein, 469 aa, Artificial Sequence; identical to SEQ ID NO: 20144
  neuraminidase__InfluenzaA__ADU76323

SEQ ID NO: 20156 - protein, 469 aa, Artificial Sequence; identical to SEQ ID NO: 20145
  neuraminidase__InfluenzaA__ADU76324

SEQ ID NO: 20157 - protein, 469 aa, Artificial Sequence; identical to SEQ ID NO: 20144
  neuraminidase__InfluenzaA__ADU76325

SEQ ID NO: 20158 - protein, 469 aa, Artificial Sequence; identical to SEQ ID NO: 20145
  neuraminidase__InfluenzaA__ADU76326

SEQ ID NO: 20159 - protein, 469 aa, Artificial Sequence; identical to SEQ ID NO: 20145
  neuraminidase__InfluenzaA__ADU76327

SEQ ID NO: 20160 - protein, 469 aa, Artificial Sequence; identical to SEQ ID NO: 20144
  neuraminidase__InfluenzaA__ADU76328

SEQ ID NO: 20161 - protein, 469 aa, Artificial Sequence; identical to SEQ ID NO: 20145
  neuraminidase__InfluenzaA__ADU76329

SEQ ID NO: 20162 - protein, 469 aa, Artificial Sequence; identical to SEQ ID NO: 20145
  neuraminidase__InfluenzaA__ADU76330

SEQ ID NO: 20163 - protein, 469 aa, Artificial Sequence; identical to SEQ ID NO: 20145
  neuraminidase__InfluenzaA__ADU76331

SEQ ID NO: 20164 - protein, 469 aa, Artificial Sequence; identical to SEQ ID NO: 20145
  neuraminidase__InfluenzaA__ADU76332

SEQ ID NO: 20165 - protein, 469 aa, Artificial Sequence; identical to SEQ ID NO: 16738
  neuraminidase__InfluenzaA__ADU76333

SEQ ID NO: 20166 - protein, 469 aa, Artificial Sequence; identical to SEQ ID NO: 16738
  neuraminidase__InfluenzaA__ADU76334

SEQ ID NO: 20167 - protein, 469 aa, Artificial Sequence; identical to SEQ ID NO: 16738
  neuraminidase__InfluenzaA__ADU76335

SEQ ID NO: 20168 - protein, 469 aa, Artificial Sequence; identical to SEQ ID NO: 20145
  neuraminidase__InfluenzaA__ADU76336

SEQ ID NO: 20169 - protein, 469 aa, Artificial Sequence; identical to SEQ ID NO: 17505
  neuraminidase__InfluenzaA__ADU76337

SEQ ID NO: 20170 - protein, 469 aa, Artificial Sequence; identical to SEQ ID NO: 18640
  neuraminidase__InfluenzaA__ADU76338

SEQ ID NO: 20171 - protein, 469 aa, Artificial Sequence; identical to SEQ ID NO: 20144
  neuraminidase__InfluenzaA__ADU76339

SEQ ID NO: 20172 - protein, 469 aa, Artificial Sequence; identical to SEQ ID NO: 16738
  neuraminidase__InfluenzaA__ADU76341

SEQ ID NO: 20173 - protein, 469 aa, Artificial Sequence; identical to SEQ ID NO: 16738
  neuraminidase__InfluenzaA__ADU76342

SEQ ID NO: 20174 - protein, 469 aa, Artificial Sequence; identical to SEQ ID NO: 16738
  neuraminidase__InfluenzaA__ADU76343

SEQ ID NO: 20175 - protein, 469 aa, Artificial Sequence; identical to SEQ ID NO: 20145
  neuraminidase__InfluenzaA__ADU76344

SEQ ID NO: 20176 - protein, 469 aa, Artificial Sequence; identical to SEQ ID NO: 20145
  neuraminidase__InfluenzaA__ADU76345

SEQ ID NO: 20177 - protein, 469 aa, Artificial Sequence
  neuraminidase__InfluenzaA__ADU76346
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTETDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20178 - protein, 469 aa, Artificial Sequence; identical to SEQ ID NO: 17505
  neuraminidase__InfluenzaA__ADU76347

SEQ ID NO: 20179 - protein, 469 aa, Artificial Sequence
  neuraminidase__InfluenzaA__ADV17285
MNPNQEIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFRYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20180 - protein, 469 aa, Artificial Sequence; identical to SEQ ID NO: 16738
  neuraminidase__InfluenzaA__ADV17295

SEQ ID NO: 20181 - protein, 469 aa, Artificial Sequence
  neuraminidase__InfluenzaA__ADV17305
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSSLECRTFFLTQGALLNDKHSNGTIKDRSPYRTLMSCPIGEVPSPYNSRFESVAWSASACHDGINWLTIGISGSDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20182 - protein, 469 aa, Artificial Sequence; identical to SEQ ID NO: 16738
  neuraminidase__InfluenzaA__ADV17315

SEQ ID NO: 20183 - protein, 469 aa, Artificial Sequence; identical to SEQ ID NO: 18169
  neuraminidase__InfluenzaA__ADV17325

SEQ ID NO: 20184 - protein, 469 aa, Artificial Sequence
  neuraminidase__InfluenzaA__ADV17335
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGVFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAECPFTIDK

SEQ ID NO: 20185 - protein, 469 aa, Artificial Sequence; identical to SEQ ID NO: 16738
  neuraminidase__InfluenzaA__ADV19022

SEQ ID NO: 20186 - protein, 469 aa, Artificial Sequence
  neuraminidase__InfluenzaA__ADV41679
MNPNQKIITIGSVCMTIGMANLILQIGNIISIWISHSIQLRNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20187 - protein, 469 aa, Artificial Sequence
  neuraminidase__InfluenzaA__ADV76582
MNPNQKIITIGSVSLTISTVCFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 20188 - protein, 469 aa, Artificial Sequence; identical to SEQ ID NO: 16599
  neuraminidase__InfluenzaA__ADV76590

SEQ ID NO: 20189 - protein, 469 aa, Artificial Sequence; identical to SEQ ID NO: 16599
  neuraminidase__InfluenzaA__ADV76601

SEQ ID NO: 20190 - protein, 469 aa, Artificial Sequence; identical to SEQ ID NO: 17592
  neuraminidase__InfluenzaA__ADV76612

SEQ ID NO: 20191 - protein, 469 aa, Artificial Sequence; identical to SEQ ID NO: 16599
  neuraminidase__InfluenzaA__ADV76623

SEQ ID NO: 20192 - protein, 469 aa, Artificial Sequence; identical to SEQ ID NO: 16599
  neuraminidase__InfluenzaA__ADV76634

SEQ ID NO: 20193 - protein, 469 aa, Artificial Sequence; identical to SEQ ID NO: 19466
  neuraminidase__InfluenzaA__ADV76645

SEQ ID NO: 20194 - protein, 469 aa, Artificial Sequence
  neuraminidase__InfluenzaA__ADV76667
MNPNQKIITIGSVSLTIATVCFLMQIAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSKSRNPNNERGNQGVKGWAFDNGDDVWMGRTISRDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 20195 - protein, 469 aa, Artificial Sequence; identical to SEQ ID NO: 19468
  neuraminidase__InfluenzaA__ADV76676

SEQ ID NO: 20196 - protein, 469 aa, Artificial Sequence; identical to SEQ ID NO: 18609
  neuraminidase__InfluenzaA__ADV76697

SEQ ID NO: 20197 - protein, 469 aa, Artificial Sequence
  neuraminidase__InfluenzaA__ADV76708
MNPNQKIITIGSVSLTISTICFFMQTAILITTVTLHFKQCEFNSPPNNQVMLCEPTIIERNITEIVYLTNITIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20198 - protein, 469 aa, Artificial Sequence
  neuraminidase__InfluenzaA__ADV76719
MNPNQKIITIGSVSLTISTICFFMQIAILITTVTLHFKQYEFNSPPNNQVMLCEPTIIEKNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQMNRQVIVDRGNRSGYSGIFSVEGKSCINRCFYVELIRGRKEETEVLWTSNSIVVFCGTSGTYGTGSWPDGADINLMPI

SEQ ID NO: 20199 - protein, 469 aa, Artificial Sequence
  neuraminidase__InfluenzaA__ADV76730
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKETLRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKDDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20200 - protein, 469 aa, Artificial Sequence
  neuraminidase__InfluenzaA__ADV78132
MNPNQKIITIGSVCMTIGMANLILQIGNIISIWISHSIQLGNQSQIETCNQSVITYENNTWLNQTYVNISNTNFAAGQSVVSVKLAGNSSLCPVSGWAIYSKDNSIRIGSKGDVFVIREPFISCSPSECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVGMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWASGSSISFCGVNSDTVGWSWPDGAELPFIIDK

SEQ ID NO: 20201 - protein, 470 aa, Artificial Sequence
  neuraminidase__InfluenzaA__ADW09104
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPNNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20202 - protein, 470 aa, Artificial Sequence; identical to SEQ ID NO: 17461
  neuraminidase__InfluenzaA__ADW09114

SEQ ID NO: 20203 - protein, 470 aa, Artificial Sequence
  neuraminidase__InfluenzaA__ADW09123
MNPNQKIITIGSISIAIGITSLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20204 - protein, 470 aa, Artificial Sequence
  neuraminidase__InfluenzaA__ADW09156
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20205 - protein, 470 aa, Artificial Sequence
  neuraminidase__InfluenzaA__ADW09167
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVNGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20206 - protein, 470 aa, Artificial Sequence; identical to SEQ ID NO: 17461
  neuraminidase__InfluenzaA__ADW09178

SEQ ID NO: 20207 - protein, 470 aa, Artificial Sequence; identical to SEQ ID NO: 17461
  neuraminidase__InfluenzaA__ADW09189

SEQ ID NO: 20208 - protein, 470 aa, Artificial Sequence; identical to SEQ ID NO: 20205
  neuraminidase__InfluenzaA__ADW09211

SEQ ID NO: 20209 - protein, 470 aa, Artificial Sequence
  neuraminidase__InfluenzaA__ADW09222
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNSVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20210 - protein, 470 aa, Artificial Sequence
  neuraminidase__InfluenzaA__ADW09233
MNPNQKIITIGSISIAIGTISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20211 - protein, 470 aa, Artificial Sequence; identical to SEQ ID NO: 20204
  neuraminidase__InfluenzaA__ADW09244

SEQ ID NO: 20212 - protein, 470 aa, Artificial Sequence; identical to SEQ ID NO: 20204
  neuraminidase__InfluenzaA__ADW09255

SEQ ID NO: 20213 - protein, 470 aa, Artificial Sequence; identical to SEQ ID NO: 20204
  neuraminidase__InfluenzaA__ADW09266

SEQ ID NO: 20214 - protein, 470 aa, Artificial Sequence; identical to SEQ ID NO: 20204
  neuraminidase__InfluenzaA__ADW09277

SEQ ID NO: 20215 - protein, 470 aa, Artificial Sequence; identical to SEQ ID NO: 17461
  neuraminidase__InfluenzaA__ADW09288

SEQ ID NO: 20216 - protein, 470 aa, Artificial Sequence; identical to SEQ ID NO: 20205
  neuraminidase__InfluenzaA__ADW09299

SEQ ID NO: 20217 - protein, 470 aa, Artificial Sequence; identical to SEQ ID NO: 17461
  neuraminidase__InfluenzaA__ADW09310

SEQ ID NO: 20218 - protein, 470 aa, Artificial Sequence; identical to SEQ ID NO: 17461
  neuraminidase__InfluenzaA__ADW09330

SEQ ID NO: 20219 - protein, 470 aa, Artificial Sequence; identical to SEQ ID NO: 20204
  neuraminidase__InfluenzaA__ADW10475

SEQ ID NO: 20220 - protein, 470 aa, Artificial Sequence; identical to SEQ ID NO: 20205
  neuraminidase__InfluenzaA__ADW10486

SEQ ID NO: 20221 - protein, 470 aa, Artificial Sequence; identical to SEQ ID NO: 17461
  neuraminidase__InfluenzaA__ADW10497

SEQ ID NO: 20222 - protein, 470 aa, Artificial Sequence
  neuraminidase__InfluenzaA__ADW10508
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALVNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVNGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20223 - protein, 470 aa, Artificial Sequence; identical to SEQ ID NO: 17461
  neuraminidase__InfluenzaA__ADW10519

SEQ ID NO: 20224 - protein, 470 aa, Artificial Sequence; identical to SEQ ID NO: 17461
  neuraminidase__InfluenzaA__ADW10530

SEQ ID NO: 20225 - protein, 470 aa, Artificial Sequence
  neuraminidase__InfluenzaA__ADW10541
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMDGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20226 - protein, 470 aa, Artificial Sequence
  neuraminidase__InfluenzaA__ADW10552
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPDFYYEECSCYPDTGIVMCVCRDNWHGSNRPWVSFNQNLDYQIGYICSGVFGDNPRPEDGEGSCNPVTVNGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20227 - protein, 470 aa, Artificial Sequence; identical to SEQ ID NO: 19937
  neuraminidase__InfluenzaA__ADW10563

SEQ ID NO: 20228 - protein, 470 aa, Artificial Sequence; identical to SEQ ID NO: 17461
  neuraminidase__InfluenzaA__ADW10574

SEQ ID NO: 20229 - protein, 470 aa, Artificial Sequence
  neuraminidase__InfluenzaA__ADW10585
MNPNQKIITIGSISIAIGIISLMLQIGSIISIWASHSIQTGSQNNTGICNQRIITYENSTWVNHTYVNINNTNVVAGEDKKSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLEYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20230 - protein, 470 aa, Artificial Sequence; identical to SEQ ID NO: 20205
  neuraminidase__InfluenzaA__ADW10596

SEQ ID NO: 20231 - protein, 470 aa, Artificial Sequence; identical to SEQ ID NO: 20204
  neuraminidase__InfluenzaA__ADW10607

SEQ ID NO: 20232 - protein, 470 aa, Artificial Sequence; identical to SEQ ID NO: 20204
  neuraminidase__InfluenzaA__ADW10618

SEQ ID NO: 20233 - protein, 470 aa, Artificial Sequence; identical to SEQ ID NO: 20204
  neuraminidase__InfluenzaA__ADW10629

SEQ ID NO: 20234 - protein, 470 aa, Artificial Sequence; identical to SEQ ID NO: 20204
  neuraminidase__InfluenzaA__ADW10724

SEQ ID NO: 20235 - protein, 470 aa, Artificial Sequence; identical to SEQ ID NO: 20205
  neuraminidase__InfluenzaA__ADW10735

SEQ ID NO: 20236 - protein, 470 aa, Artificial Sequence; identical to SEQ ID NO: 20205
  neuraminidase__InfluenzaA__ADW10746

SEQ ID NO: 20237 - protein, 470 aa, Artificial Sequence
  neuraminidase__InfluenzaA__ADW10757
MNPNQKIITIGSISIAIGIISLMLQIGNIISIWASHSIQTRSQNNTGICNQRIITYENSTWVNHTYVNINNTNVVAGGDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTLMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20238 - protein, 470 aa, Artificial Sequence; identical to SEQ ID NO: 20204
  neuraminidase__InfluenzaA__ADW10768

SEQ ID NO: 20239 - protein, 470 aa, Artificial Sequence; identical to SEQ ID NO: 17461
  neuraminidase__InfluenzaA__ADW10779

SEQ ID NO: 20240 - protein, 470 aa, Artificial Sequence
  neuraminidase__InfluenzaA__ADW10790
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIIPCFWVELVRGLPRENATIWTSGSSISFCGVNSDTANWSWPDGAELPFTIDK

SEQ ID NO: 20241 - protein, 470 aa, Artificial Sequence; identical to SEQ ID NO: 18930
  neuraminidase__InfluenzaA__ADW10801

SEQ ID NO: 20242 - protein, 470 aa, Artificial Sequence; identical to SEQ ID NO: 20204
  neuraminidase__InfluenzaA__ADW10812

SEQ ID NO: 20243 - protein, 470 aa, Artificial Sequence; identical to SEQ ID NO: 19956
  neuraminidase__InfluenzaA__ADW10823

SEQ ID NO: 20244 - protein, 470 aa, Artificial Sequence
  neuraminidase__InfluenzaA__ADW10834
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVIKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20245 - protein, 470 aa, Artificial Sequence; identical to SEQ ID NO: 20205
  neuraminidase__InfluenzaA__ADW10845

SEQ ID NO: 20246 - protein, 470 aa, Artificial Sequence
  neuraminidase__InfluenzaA__ADW10856
MNPNQRIITIGSISIAIGIISLMLQIGNIISIWASHSIQTGSQNNTGICNQRIITYENSTWVNHTYVNINNTNVVAGEDKTSMTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20247 - protein, 470 aa, Artificial Sequence; identical to SEQ ID NO: 20204
  neuraminidase__InfluenzaA__ADW10867

SEQ ID NO: 20248 - protein, 470 aa, Artificial Sequence; identical to SEQ ID NO: 20204
  neuraminidase__InfluenzaA__ADW10878

SEQ ID NO: 20249 - protein, 470 aa, Artificial Sequence; identical to SEQ ID NO: 20204
  neuraminidase__InfluenzaA__ADW10889

SEQ ID NO: 20250 - protein, 470 aa, Artificial Sequence; identical to SEQ ID NO: 17461
  neuraminidase__InfluenzaA__ADW10900

SEQ ID NO: 20251 - protein, 469 aa, Artificial Sequence; identical to SEQ ID NO: 18484
  neuraminidase__InfluenzaA__ADW11155

SEQ ID NO: 20252 - protein, 469 aa, Artificial Sequence; identical to SEQ ID NO: 16738
  neuraminidase__InfluenzaA__ADW23530

SEQ ID NO: 20253 - protein, 469 aa, Artificial Sequence
  neuraminidase__InfluenzaA__ADW54483
MNPNQKIITIGSVCMTIGMANLMLQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20254 - protein, 469 aa, Artificial Sequence
  neuraminidase__InfluenzaA__ADW54494
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 20255 - protein, 469 aa, Artificial Sequence
  neuraminidase__InfluenzaA__ADW54514
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWKNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSKKQDIIGINEWSGYSGSFVQHPELTGLDCIRPCFWVELIRGRPKENTIWTSGSSISFCGVNSDTVGWSWPDGAELPFTIDK

SEQ ID NO: 20256 - protein, 469 aa, Artificial Sequence
  neuraminidase__InfluenzaA__ADW54522
MNPNQKIITIGSVCMIIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNRLRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20257 - protein, 469 aa, Artificial Sequence
  neuraminidase__InfluenzaA__ADW65826
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20258 - protein, 469 aa, Artificial Sequence; identical to SEQ ID NO: 16599
  neuraminidase__InfluenzaA__ADW80519

SEQ ID NO: 20259 - protein, 469 aa, Artificial Sequence; identical to SEQ ID NO: 16599
  neuraminidase__InfluenzaA__ADW82127

SEQ ID NO: 20260 - protein, 469 aa, Artificial Sequence; identical to SEQ ID NO: 16599
  neuraminidase__InfluenzaA__ADW82138

SEQ ID NO: 20261 - protein, 469 aa, Artificial Sequence; identical to SEQ ID NO: 16599
  neuraminidase__InfluenzaA__ADW82149

SEQ ID NO: 20262 - protein, 469 aa, Artificial Sequence; identical to SEQ ID NO: 16599
  neuraminidase__InfluenzaA__ADW82158

SEQ ID NO: 20263 - protein, 469 aa, Artificial Sequence; identical to SEQ ID NO: 16599
  neuraminidase__InfluenzaA__ADW82169

SEQ ID NO: 20264 - protein, 469 aa, Artificial Sequence; identical to SEQ ID NO: 16599
  neuraminidase__InfluenzaA__ADW82180

SEQ ID NO: 20265 - protein, 469 aa, Artificial Sequence; identical to SEQ ID NO: 16738
  neuraminidase__InfluenzaA__ADW82191

SEQ ID NO: 20266 - protein, 469 aa, Artificial Sequence; identical to SEQ ID NO: 16738
  neuraminidase__InfluenzaA__ADW82201

SEQ ID NO: 20267 - protein, 469 aa, Artificial Sequence; identical to SEQ ID NO: 16738
  neuraminidase__InfluenzaA__ADW82211

SEQ ID NO: 20268 - protein, 469 aa, Artificial Sequence; identical to SEQ ID NO: 16738
  neuraminidase__InfluenzaA__ADW82221

SEQ ID NO: 20269 - protein, 469 aa, Artificial Sequence; identical to SEQ ID NO: 16738
  neuraminidase__InfluenzaA__ADW82231

SEQ ID NO: 20270 - protein, 469 aa, Artificial Sequence; identical to SEQ ID NO: 16738
  neuraminidase__InfluenzaA__ADW82241

SEQ ID NO: 20271 - protein, 469 aa, Artificial Sequence; identical to SEQ ID NO: 16738
  neuraminidase__InfluenzaA__ADW82251

SEQ ID NO: 20272 - protein, 469 aa, Artificial Sequence; identical to SEQ ID NO: 16738
  neuraminidase__InfluenzaA__ADW82261

SEQ ID NO: 20273 - protein, 469 aa, Artificial Sequence; identical to SEQ ID NO: 16738
  neuraminidase__InfluenzaA__ADW82271

SEQ ID NO: 20274 - protein, 469 aa, Artificial Sequence; identical to SEQ ID NO: 20257
  neuraminidase__InfluenzaA__ADW95306

SEQ ID NO: 20275 - protein, 469 aa, Artificial Sequence; identical to SEQ ID NO: 20257
  neuraminidase__InfluenzaA__ADW95313

SEQ ID NO: 20276 - protein, 469 aa, Artificial Sequence; identical to SEQ ID NO: 20257
  neuraminidase__InfluenzaA__ADW95320

SEQ ID NO: 20277 - protein, 469 aa, Artificial Sequence; identical to SEQ ID NO: 20257
  neuraminidase__InfluenzaA__ADW95327

SEQ ID NO: 20278 - protein, 469 aa, Artificial Sequence
  neuraminidase__InfluenzaA__ADW95333
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGSAKSISSRKAFEMIWDPNGWTGTDNNFSIKQYIVGINEWSGYSGSFVEHPELTGLDCIRPCFWVELIRGRPKENTIWTSGSSISFCGVNSDTVGWSWPDGAELPFTIDK

SEQ ID NO: 20279 - protein, 469 aa, Artificial Sequence
  neuraminidase__InfluenzaA__ADX20813
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFELVAWSASACHDGINWLTIGISGPDNGAVAVLKYNGIITDTIKSWRNNILRTQESECACVNGSCFTVMTDGPSDGQTSYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20280 - protein, 469 aa, Artificial Sequence
  neuraminidase__InfluenzaA__ADX20814
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20281 - protein, 469 aa, Artificial Sequence; identical to SEQ ID NO: 16599
  neuraminidase__InfluenzaA__ADX21091

SEQ ID NO: 20282 - protein, 469 aa, Artificial Sequence; identical to SEQ ID NO: 16738
  neuraminidase__InfluenzaA__ADX21101

SEQ ID NO: 20283 - protein, 469 aa, Artificial Sequence; identical to SEQ ID NO: 17605
  neuraminidase__InfluenzaA__ADX36112

SEQ ID NO: 20284 - protein, 469 aa, Artificial Sequence
  neuraminidase__InfluenzaA__ADX87386
MNPNQRIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 20285 - protein, 469 aa, Artificial Sequence
  neuraminidase__InfluenzaA__ADX96270
MNPNQKIITIGSVCMTIGMANLILQIGNIISIWISHSIQLGNQNQIETCNQSIITYENNTWVNQTYVNISNTNFAAGQSVASVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20286 - protein, 469 aa, Artificial Sequence; identical to SEQ ID NO: 20285
  neuraminidase__InfluenzaA__ADX96280

SEQ ID NO: 20287 - protein, 469 aa, Artificial Sequence; identical to SEQ ID NO: 17321
  neuraminidase__InfluenzaA__ADX96290

SEQ ID NO: 20288 - protein, 469 aa, Artificial Sequence; identical to SEQ ID NO: 16738
  neuraminidase__InfluenzaA__ADX96300

SEQ ID NO: 20289 - protein, 469 aa, Artificial Sequence; identical to SEQ ID NO: 16738
  neuraminidase__InfluenzaA__ADX96310

SEQ ID NO: 20290 - protein, 469 aa, Artificial Sequence
  neuraminidase__InfluenzaA__ADX96330
MNPNQKIITIGSVCMTIGMANLILQIGNGISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSNEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20291 - protein, 469 aa, Artificial Sequence; identical to SEQ ID NO: 16738
  neuraminidase__InfluenzaA__ADX96339

SEQ ID NO: 20292 - protein, 469 aa, Artificial Sequence
  neuraminidase__InfluenzaA__ADX96349
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSNEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20293 - protein, 469 aa, Artificial Sequence; identical to SEQ ID NO: 16738
  neuraminidase__InfluenzaA__ADX96359

SEQ ID NO: 20294 - protein, 469 aa, Artificial Sequence; identical to SEQ ID NO: 16738
  neuraminidase__InfluenzaA__ADX96369

SEQ ID NO: 20295 - protein, 469 aa, Artificial Sequence
  neuraminidase__InfluenzaA__ADX96380
MNPNQKIITIGSVCMTIGMANLILQIGNIISIWPVHSIQLGNQNQIETCNQSVITYENNTWVNQTYVNISNTNFAAGQSVVSMKLAGNSSLCPVGGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVESVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20296 - protein, 469 aa, Artificial Sequence
  neuraminidase__InfluenzaA__ADX96390
MNPNQKIITIGSVCMTIGMANLILQIGNIISIWLSHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20297 - protein, 469 aa, Artificial Sequence; identical to SEQ ID NO: 16738
  neuraminidase__InfluenzaA__ADX96400

SEQ ID NO: 20298 - protein, 469 aa, Artificial Sequence; identical to SEQ ID NO: 16738
  neuraminidase__InfluenzaA__ADX96410

SEQ ID NO: 20299 - protein, 469 aa, Artificial Sequence; identical to SEQ ID NO: 16738
  neuraminidase__InfluenzaA__ADX96419

SEQ ID NO: 20300 - protein, 469 aa, Artificial Sequence
  neuraminidase__InfluenzaA__ADX96429
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVRINEWSGYSGSFVQHPELTGLDCIRPCFWVELIRGRPKENTIWTSGSSISFCGVNSDTVGWSWPDGAELPFTIDK

SEQ ID NO: 20301 - protein, 469 aa, Artificial Sequence; identical to SEQ ID NO: 16738
  neuraminidase__InfluenzaA__ADX96449

SEQ ID NO: 20302 - protein, 469 aa, Artificial Sequence; identical to SEQ ID NO: 16738
  neuraminidase__InfluenzaA__ADX96469

SEQ ID NO: 20303 - protein, 469 aa, Artificial Sequence; identical to SEQ ID NO: 16738
  neuraminidase__InfluenzaA__ADX96489

SEQ ID NO: 20304 - protein, 469 aa, Artificial Sequence; identical to SEQ ID NO: 16738
  neuraminidase__InfluenzaA__ADX96499

SEQ ID NO: 20305 - protein, 469 aa, Artificial Sequence
  neuraminidase__InfluenzaA__ADX96509
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSNGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20306 - protein, 469 aa, Artificial Sequence; identical to SEQ ID NO: 16738
  neuraminidase__InfluenzaA__ADX96519

SEQ ID NO: 20307 - protein, 469 aa, Artificial Sequence; identical to SEQ ID NO: 16738
  neuraminidase__InfluenzaA__ADX96529

SEQ ID NO: 20308 - protein, 469 aa, Artificial Sequence; identical to SEQ ID NO: 16738
  neuraminidase__InfluenzaA__ADX96539

SEQ ID NO: 20309 - protein, 469 aa, Artificial Sequence; identical to SEQ ID NO: 16738
  neuraminidase__InfluenzaA__ADX96549

SEQ ID NO: 20310 - protein, 469 aa, Artificial Sequence; identical to SEQ ID NO: 16738
  neuraminidase__InfluenzaA__ADX96559

SEQ ID NO: 20311 - protein, 469 aa, Artificial Sequence; identical to SEQ ID NO: 16738
  neuraminidase__InfluenzaA__ADX96569

SEQ ID NO: 20312 - protein, 469 aa, Artificial Sequence; identical to SEQ ID NO: 16728
  neuraminidase__InfluenzaA__ADX96579

SEQ ID NO: 20313 - protein, 469 aa, Artificial Sequence; identical to SEQ ID NO: 16738
  neuraminidase__InfluenzaA__ADX96589

SEQ ID NO: 20314 - protein, 469 aa, Artificial Sequence; identical to SEQ ID NO: 16738
  neuraminidase__InfluenzaA__ADX96599

SEQ ID NO: 20315 - protein, 469 aa, Artificial Sequence
  neuraminidase__InfluenzaA__ADX96609
MNPNQKIITIGSVCMTIGMANLILQIGNIISIWISHSIQLGNQNQIETCNQSVITYENNTWVNQTYVNISNTNFAAGQSVVSVKLAGNSSLCPVGGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGDGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20316 - protein, 469 aa, Artificial Sequence; identical to SEQ ID NO: 16728
  neuraminidase__InfluenzaA__ADX96619

SEQ ID NO: 20317 - protein, 469 aa, Artificial Sequence; identical to SEQ ID NO: 16738
  neuraminidase__InfluenzaA__ADX96629

SEQ ID NO: 20318 - protein, 469 aa, Artificial Sequence; identical to SEQ ID NO: 16738
  neuraminidase__InfluenzaA__ADX96639

SEQ ID NO: 20319 - protein, 469 aa, Artificial Sequence; identical to SEQ ID NO: 16738
  neuraminidase__InfluenzaA__ADX96649

SEQ ID NO: 20320 - protein, 469 aa, Artificial Sequence; identical to SEQ ID NO: 16728
  neuraminidase__InfluenzaA__ADX96659

SEQ ID NO: 20321 - protein, 469 aa, Artificial Sequence; identical to SEQ ID NO: 16738
  neuraminidase__InfluenzaA__ADX96669

SEQ ID NO: 20322 - protein, 469 aa, Artificial Sequence; identical to SEQ ID NO: 16738
  neuraminidase__InfluenzaA__ADX96679

SEQ ID NO: 20323 - protein, 469 aa, Artificial Sequence; identical to SEQ ID NO: 16738
  neuraminidase__InfluenzaA__ADX96689

SEQ ID NO: 20324 - protein, 469 aa, Artificial Sequence; identical to SEQ ID NO: 16738
  neuraminidase__InfluenzaA__ADX96699

SEQ ID NO: 20325 - protein, 469 aa, Artificial Sequence
  neuraminidase__InfluenzaA__ADX96709
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEINAPNYHYEECSCYPDSSEITCVCRDNWHGSNRPWVSFNQNLEYQIGYICSGIFGDNPRPNDETGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20326 - protein, 469 aa, Artificial Sequence
  neuraminidase__InfluenzaA__ADX96719
MNPNQKIITIGSVCMTIGMANLILQIGNIISIWISHSIQLGNQNQIETCNQSVITYENNTWVNQTYVNISNTNFAAGQSVVSVKFAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKESTVWTSGSSISFCGVNSDTVGWSWPDGAELPFTIDK

SEQ ID NO: 20327 - protein, 469 aa, Artificial Sequence; identical to SEQ ID NO: 16738
  neuraminidase__InfluenzaA__ADX96729

SEQ ID NO: 20328 - protein, 469 aa, Artificial Sequence
  neuraminidase__InfluenzaA__ADX96739
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVKSDTVGWSWPDGAELPFTIDK

SEQ ID NO: 20329 - protein, 469 aa, Artificial Sequence; identical to SEQ ID NO: 16738
  neuraminidase__InfluenzaA__ADX96749

SEQ ID NO: 20330 - protein, 469 aa, Artificial Sequence; identical to SEQ ID NO: 16738
  neuraminidase__InfluenzaA__ADX96759

SEQ ID NO: 20331 - protein, 469 aa, Artificial Sequence; identical to SEQ ID NO: 17712
  neuraminidase__InfluenzaA__ADX96769

SEQ ID NO: 20332 - protein, 469 aa, Artificial Sequence; identical to SEQ ID NO: 16738
  neuraminidase__InfluenzaA__ADX96779

SEQ ID NO: 20333 - protein, 469 aa, Artificial Sequence
  neuraminidase__InfluenzaA__ADX96789
MNPNQKIITIGSVCMTIGMANLILQIGNIISIWISHSIQLGNQNQIETCNQSVITYENNTWVNQTYVNISNTNFAAGQSVVSLKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20334 - protein, 469 aa, Artificial Sequence; identical to SEQ ID NO: 16738
  neuraminidase__InfluenzaA__ADX96799

SEQ ID NO: 20335 - protein, 469 aa, Artificial Sequence; identical to SEQ ID NO: 16893
  neuraminidase__InfluenzaA__ADX96809

SEQ ID NO: 20336 - protein, 469 aa, Artificial Sequence; identical to SEQ ID NO: 16738
  neuraminidase__InfluenzaA__ADX96819

SEQ ID NO: 20337 - protein, 469 aa, Artificial Sequence; identical to SEQ ID NO: 17961
  neuraminidase__InfluenzaA__ADX96829

SEQ ID NO: 20338 - protein, 469 aa, Artificial Sequence
  neuraminidase__InfluenzaA__ADX96839
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNNVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20339 - protein, 469 aa, Artificial Sequence; identical to SEQ ID NO: 16738
  neuraminidase__InfluenzaA__ADX96849

SEQ ID NO: 20340 - protein, 469 aa, Artificial Sequence; identical to SEQ ID NO: 16738
  neuraminidase__InfluenzaA__ADX96859

SEQ ID NO: 20341 - protein, 469 aa, Artificial Sequence; identical to SEQ ID NO: 17961
  neuraminidase__InfluenzaA__ADX96869

SEQ ID NO: 20342 - protein, 469 aa, Artificial Sequence; identical to SEQ ID NO: 16738
  neuraminidase__InfluenzaA__ADX96879

SEQ ID NO: 20343 - protein, 469 aa, Artificial Sequence; identical to SEQ ID NO: 16738
  neuraminidase__InfluenzaA__ADX96899

SEQ ID NO: 20344 - protein, 469 aa, Artificial Sequence
  neuraminidase__InfluenzaA__ADX96909
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNDILRTQESECACVNGSCFTVMTDGPSDGQASYKIFRIEKGKIVKSVEINAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSINSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20345 - protein, 469 aa, Artificial Sequence; identical to SEQ ID NO: 16738
  neuraminidase__InfluenzaA__ADX96919

SEQ ID NO: 20346 - protein, 469 aa, Artificial Sequence; identical to SEQ ID NO: 16738
  neuraminidase__InfluenzaA__ADX96929

SEQ ID NO: 20347 - protein, 469 aa, Artificial Sequence; identical to SEQ ID NO: 16738
  neuraminidase__InfluenzaA__ADX96939

SEQ ID NO: 20348 - protein, 469 aa, Artificial Sequence; identical to SEQ ID NO: 17321
  neuraminidase__InfluenzaA__ADX96949

SEQ ID NO: 20349 - protein, 469 aa, Artificial Sequence; identical to SEQ ID NO: 16738
  neuraminidase__InfluenzaA__ADX96959

SEQ ID NO: 20350 - protein, 469 aa, Artificial Sequence
  neuraminidase__InfluenzaA__ADX96969
MNPNQMIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20351 - protein, 469 aa, Artificial Sequence; identical to SEQ ID NO: 17961
  neuraminidase__InfluenzaA__ADX96979

SEQ ID NO: 20352 - protein, 469 aa, Artificial Sequence; identical to SEQ ID NO: 17961
  neuraminidase__InfluenzaA__ADX96989

SEQ ID NO: 20353 - protein, 468 aa, Artificial Sequence
  neuraminidase__InfluenzaA__ADX96999
MNPNQKIITIGSVCMTIGMANLILQIGIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20354 - protein, 469 aa, Artificial Sequence; identical to SEQ ID NO: 16738
  neuraminidase__InfluenzaA__ADX97009

SEQ ID NO: 20355 - protein, 469 aa, Artificial Sequence; identical to SEQ ID NO: 16893
  neuraminidase__InfluenzaA__ADX97020

SEQ ID NO: 20356 - protein, 469 aa, Artificial Sequence
  neuraminidase__InfluenzaA__ADX97030
MNPNQKIITIGSVCMIIGMANLMLQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20357 - protein, 469 aa, Artificial Sequence; identical to SEQ ID NO: 18286
  neuraminidase__InfluenzaA__ADX98643

SEQ ID NO: 20358 - protein, 469 aa, Artificial Sequence; identical to SEQ ID NO: 16738
  neuraminidase__InfluenzaA__ADX98653

SEQ ID NO: 20359 - protein, 469 aa, Artificial Sequence
  neuraminidase__InfluenzaA__ADX98668
MNPNQKIITIGSICITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20360 - protein, 469 aa, Artificial Sequence; identical to SEQ ID NO: 16738
  neuraminidase__InfluenzaA__ADX98678

SEQ ID NO: 20361 - protein, 469 aa, Artificial Sequence; identical to SEQ ID NO: 16738
  neuraminidase__InfluenzaA__ADX98698

SEQ ID NO: 20362 - protein, 469 aa, Artificial Sequence
  neuraminidase__InfluenzaA__ADX98708
MNPNQKIITIGSVCMTIGMANLILQIGNIISIWISHSIQLGNQNQIETCNQSVIIYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20363 - protein, 469 aa, Artificial Sequence; identical to SEQ ID NO: 16738
  neuraminidase__InfluenzaA__ADX98722

SEQ ID NO: 20364 - protein, 469 aa, Artificial Sequence; identical to SEQ ID NO: 16738
  neuraminidase__InfluenzaA__ADX98732

SEQ ID NO: 20365 - protein, 469 aa, Artificial Sequence; identical to SEQ ID NO: 16738
  neuraminidase__InfluenzaA__ADX98742

SEQ ID NO: 20366 - protein, 469 aa, Artificial Sequence; identical to SEQ ID NO: 18089
  neuraminidase__InfluenzaA__ADX98751

SEQ ID NO: 20367 - protein, 469 aa, Artificial Sequence; identical to SEQ ID NO: 16738
  neuraminidase__InfluenzaA__ADX98761

SEQ ID NO: 20368 - protein, 469 aa, Artificial Sequence
  neuraminidase__InfluenzaA__ADX98770
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWGSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20369 - protein, 469 aa, Artificial Sequence; identical to SEQ ID NO: 16738
  neuraminidase__InfluenzaA__ADX98780

SEQ ID NO: 20370 - protein, 469 aa, Artificial Sequence
  neuraminidase__InfluenzaA__ADX98788
MNPNQKIITIGSVCMTIGMANLVLQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 20371 - protein, 469 aa, Artificial Sequence
  neuraminidase__InfluenzaA__ADX98809
MNPNQKIITIGSVCMTIGMANLILQIGNIILIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20372 - protein, 469 aa, Artificial Sequence; identical to SEQ ID NO: 16738
  neuraminidase__InfluenzaA__ADX98821

SEQ ID NO: 20373 - protein, 469 aa, Artificial Sequence; identical to SEQ ID NO: 16738
  neuraminidase__InfluenzaA__ADX98846

SEQ ID NO: 20374 - protein, 469 aa, Artificial Sequence
  neuraminidase__InfluenzaA__ADX98856
MNPNQKIMTIGSVCMTIGMANLILQIGNIISIWISHSIQLGIQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20375 - protein, 469 aa, Artificial Sequence; identical to SEQ ID NO: 16738
  neuraminidase__InfluenzaA__ADX98863

SEQ ID NO: 20376 - protein, 469 aa, Artificial Sequence; identical to SEQ ID NO: 16738
  neuraminidase__InfluenzaA__ADX98873

SEQ ID NO: 20377 - protein, 469 aa, Artificial Sequence
  neuraminidase__InfluenzaA__ADX98883
MNPNQKIITIGSVCMTIGMANLILQIGNIISIWISHSIQLGNQNQIETCNQSVITYENNTWVNQTYVNISNTNVAAGQSVVSVKLAGNSSLCPVSGWAIYSKDNSIRIGSKGDAFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRSGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20378 - protein, 469 aa, Artificial Sequence; identical to SEQ ID NO: 16738
  neuraminidase__InfluenzaA__ADX98893

SEQ ID NO: 20379 - protein, 469 aa, Artificial Sequence; identical to SEQ ID NO: 16738
  neuraminidase__InfluenzaA__ADX98903

SEQ ID NO: 20380 - protein, 469 aa, Artificial Sequence; identical to SEQ ID NO: 18291
  neuraminidase__InfluenzaA__ADX98913

SEQ ID NO: 20381 - protein, 469 aa, Artificial Sequence; identical to SEQ ID NO: 18169
  neuraminidase__InfluenzaA__ADX98923

SEQ ID NO: 20382 - protein, 469 aa, Artificial Sequence; identical to SEQ ID NO: 18175
  neuraminidase__InfluenzaA__ADX98933

SEQ ID NO: 20383 - protein, 469 aa, Artificial Sequence; identical to SEQ ID NO: 16738
  neuraminidase__InfluenzaA__ADX98943

SEQ ID NO: 20384 - protein, 469 aa, Artificial Sequence; identical to SEQ ID NO: 18695
  neuraminidase__InfluenzaA__ADX98953

SEQ ID NO: 20385 - protein, 469 aa, Artificial Sequence; identical to SEQ ID NO: 16738
  neuraminidase__InfluenzaA__ADX98963

SEQ ID NO: 20386 - protein, 469 aa, Artificial Sequence
  neuraminidase__InfluenzaA__ADX98973
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMICPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20387 - protein, 469 aa, Artificial Sequence; identical to SEQ ID NO: 16738
  neuraminidase__InfluenzaA__ADX98983

SEQ ID NO: 20388 - protein, 469 aa, Artificial Sequence; identical to SEQ ID NO: 16738
  neuraminidase__InfluenzaA__ADX98993

SEQ ID NO: 20389 - protein, 469 aa, Artificial Sequence; identical to SEQ ID NO: 16738
  neuraminidase__InfluenzaA__ADX99003

SEQ ID NO: 20390 - protein, 454 aa, Artificial Sequence
  neuraminidase__InfluenzaA__ADX99584
MNPNQKITTIGSICLVVGLISLILQIGNIISIWISHSIQTGSQNHTGICNQNIITYKNSTWVKDTTSVILTGNSSLCPIRGWAIYSKDNSIRIGSKGDVFVIREPFISCSHLECRTFFLTQGALLNDKHSNGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSDGLASYKIFKIEKGKVTKSIELNAPNSHYEECSCYPDTGKVMCVCRDNWHGSNRPWVSFDQNLDYQIGYICSGVFGDNPRPEDGTGSCGPVYVDGANGVKGFSYRYGNGVWIGRTKSHSSRHGFEMIWDPNGWTETDSKFSVRQDVVAMTDWSGYSGSFVQHPELTGLDCMRPCFWVELIRGRPKEKTIWTSASSISFCGVNSDTVDWSWPDGAELPFSIDK

SEQ ID NO: 20391 - protein, 454 aa, Artificial Sequence; identical to SEQ ID NO: 20390
  neuraminidase__InfluenzaA__ADX99595

SEQ ID NO: 20392 - protein, 454 aa, Artificial Sequence; identical to SEQ ID NO: 20390
  neuraminidase__InfluenzaA__ADX99606

SEQ ID NO: 20393 - protein, 454 aa, Artificial Sequence; identical to SEQ ID NO: 20390
  neuraminidase__InfluenzaA__ADX99617

SEQ ID NO: 20394 - protein, 454 aa, Artificial Sequence; identical to SEQ ID NO: 20390
  neuraminidase__InfluenzaA__ADX99628

SEQ ID NO: 20395 - protein, 454 aa, Artificial Sequence; identical to SEQ ID NO: 20390
  neuraminidase__InfluenzaA__ADX99639

SEQ ID NO: 20396 - protein, 454 aa, Artificial Sequence; identical to SEQ ID NO: 15719
  neuraminidase__InfluenzaA__ADX99650

SEQ ID NO: 20397 - protein, 454 aa, Artificial Sequence; identical to SEQ ID NO: 15719
  neuraminidase__InfluenzaA__ADX99672

SEQ ID NO: 20398 - protein, 454 aa, Artificial Sequence; identical to SEQ ID NO: 15719
  neuraminidase__InfluenzaA__ADX99683

SEQ ID NO: 20399 - protein, 454 aa, Artificial Sequence; identical to SEQ ID NO: 15719
  neuraminidase__InfluenzaA__ADX99694

SEQ ID NO: 20400 - protein, 454 aa, Artificial Sequence; identical to SEQ ID NO: 15719
  neuraminidase__InfluenzaA__ADX99705

SEQ ID NO: 20401 - protein, 454 aa, Artificial Sequence; identical to SEQ ID NO: 15719
  neuraminidase__InfluenzaA__ADX99846

SEQ ID NO: 20402 - protein, 454 aa, Artificial Sequence; identical to SEQ ID NO: 15719
  neuraminidase__InfluenzaA__ADX99857

SEQ ID NO: 20403 - protein, 454 aa, Artificial Sequence; identical to SEQ ID NO: 15719
  neuraminidase__InfluenzaA__ADX99868

SEQ ID NO: 20404 - protein, 454 aa, Artificial Sequence; identical to SEQ ID NO: 15719
  neuraminidase__InfluenzaA__ADX99879

SEQ ID NO: 20405 - protein, 454 aa, Artificial Sequence; identical to SEQ ID NO: 15719
  neuraminidase__InfluenzaA__ADX99890

SEQ ID NO: 20406 - protein, 454 aa, Artificial Sequence; identical to SEQ ID NO: 15719
  neuraminidase__InfluenzaA__ADX99901

SEQ ID NO: 20407 - protein, 454 aa, Artificial Sequence
  neuraminidase__InfluenzaA__ADX99912
MNPNQKIITIGSICLVVGLISLILQIGNIISIWISHSIQTGSQNHTGICNQNIITYKNSTWVKDTTSVILTGNSSLCPIRGWAIYSKDNSIRIGSKGDVFIIREPFISCSHLECRTFFLTQGALLNDKHSSGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSDGLASYKIFKIEKGKVTKSIELNAPNSHYEECSCYPDTGKVMCVCRDNWHGSNRPWVSFDQNLDYQIGYICSGVFGDNPRPEDGTGSCGPVYVDGANGVKGFSYRYGNGVWIGRTKSHSSRHGFEMIWDPNGWTETDSKFSVRQDVVAMTDWSGYSGSFVQHPELTGLDCMRPCFWVELIRGRPKEKTIWTSASSISFCGVNSDTVDWSWPDGAELPFSIDK

SEQ ID NO: 20408 - protein, 454 aa, Artificial Sequence; identical to SEQ ID NO: 15719
  neuraminidase__InfluenzaA__ADX99923

SEQ ID NO: 20409 - protein, 454 aa, Artificial Sequence; identical to SEQ ID NO: 15719
  neuraminidase__InfluenzaA__ADX99934

SEQ ID NO: 20410 - protein, 454 aa, Artificial Sequence; identical to SEQ ID NO: 15719
  neuraminidase__InfluenzaA__ADX99956

SEQ ID NO: 20411 - protein, 454 aa, Artificial Sequence; identical to SEQ ID NO: 15719
  neuraminidase__InfluenzaA__ADX99967

SEQ ID NO: 20412 - protein, 454 aa, Artificial Sequence; identical to SEQ ID NO: 15719
  neuraminidase__InfluenzaA__ADX99978

SEQ ID NO: 20413 - protein, 454 aa, Artificial Sequence; identical to SEQ ID NO: 15719
  neuraminidase__InfluenzaA__ADX99989

SEQ ID NO: 20414 - protein, 454 aa, Artificial Sequence; identical to SEQ ID NO: 15719
  neuraminidase__InfluenzaA__ADY00001

SEQ ID NO: 20415 - protein, 454 aa, Artificial Sequence; identical to SEQ ID NO: 15719
  neuraminidase__InfluenzaA__ADY00012

SEQ ID NO: 20416 - protein, 454 aa, Artificial Sequence; identical to SEQ ID NO: 15719
  neuraminidase__InfluenzaA__ADY00023

SEQ ID NO: 20417 - protein, 470 aa, Artificial Sequence
  neuraminidase__InfluenzaA__ADY04729
MNPNQKIITIGSISIAIGIISLMLQIGNIISIWASHSIQTGSQNHTGVCNQRIITYENSTWVNHTYVNINNTNVIAGKDKTSVTMAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 20418 - protein, 469 aa, Artificial Sequence; identical to SEQ ID NO: 19518
  neuraminidase__InfluenzaA__ADY11828

SEQ ID NO: 20419 - protein, 469 aa, Artificial Sequence; identical to SEQ ID NO: 16599
  neuraminidase__InfluenzaA__ADY11839

SEQ ID NO: 20420 - protein, 469 aa, Artificial Sequence; identical to SEQ ID NO: 16599
  neuraminidase__InfluenzaA__ADY17657

SEQ ID NO: 20421 - protein, 469 aa, Artificial Sequence; identical to SEQ ID NO: 16599
  neuraminidase__InfluenzaA__ADY17668

SEQ ID NO: 20422 - protein, 469 aa, Artificial Sequence; identical to SEQ ID NO: 16599
  neuraminidase__InfluenzaA__ADY17679

SEQ ID NO: 20423 - protein, 469 aa, Artificial Sequence; identical to SEQ ID NO: 16599
  neuraminidase__InfluenzaA__ADY17690

SEQ ID NO: 20424 - protein, 469 aa, Artificial Sequence; identical to SEQ ID NO: 16599
  neuraminidase__InfluenzaA__ADY17701

SEQ ID NO: 20425 - protein, 469 aa, Artificial Sequence; identical to SEQ ID NO: 16738
  neuraminidase__InfluenzaA__ADY38722

SEQ ID NO: 20426 - protein, 469 aa, Artificial Sequence; identical to SEQ ID NO: 18487
  neuraminidase__InfluenzaA__ADY38723

SEQ ID NO: 20427 - protein, 469 aa, Artificial Sequence; identical to SEQ ID NO: 16738
  neuraminidase__InfluenzaA__ADY38734

SEQ ID NO: 20428 - protein, 469 aa, Artificial Sequence; identical to SEQ ID NO: 18330
  neuraminidase__InfluenzaA__ADY38753

SEQ ID NO: 20429 - protein, 469 aa, Artificial Sequence; identical to SEQ ID NO: 16738
  neuraminidase__InfluenzaA__ADY38763

SEQ ID NO: 20430 - protein, 469 aa, Artificial Sequence; identical to SEQ ID NO: 16738
  neuraminidase__InfluenzaA__ADZ04600

SEQ ID NO: 20431 - protein, 469 aa, Artificial Sequence; identical to SEQ ID NO: 16738
  neuraminidase__InfluenzaA__ADZ04610

SEQ ID NO: 20432 - protein, 469 aa, Artificial Sequence; identical to SEQ ID NO: 16738
  neuraminidase__InfluenzaA__ADZ04693

SEQ ID NO: 20433 - protein, 469 aa, Artificial Sequence; identical to SEQ ID NO: 16738
  neuraminidase__InfluenzaA__ADZ04701

SEQ ID NO: 20434 - protein, 469 aa, Artificial Sequence; identical to SEQ ID NO: 16738
  neuraminidase__InfluenzaA__ADZ04711

SEQ ID NO: 20435 - protein, 469 aa, Artificial Sequence
  neuraminidase__InfluenzaA__ADZ05393
MNPNQKIITIDSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20436 - protein, 470 aa, Artificial Sequence
  neuraminidase__InfluenzaA__ADZ05837
MNPNQKIITIGSISIAIGIISLMLQIGNIISIWASHSIQTGSQNNTGICNQRIITCENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVATTDWSGYSGSFVQHPELTGLDCIRPCFWVELVRGLPRENTTIWTSGSSISFCGVNSDTANWSWPDGAELPFTIDK

SEQ ID NO: 20437 - protein, 470 aa, Artificial Sequence; identical to SEQ ID NO: 17461
  neuraminidase__InfluenzaA__ADZ05848

SEQ ID NO: 20438 - protein, 469 aa, Artificial Sequence; identical to SEQ ID NO: 17905
  neuraminidase__InfluenzaA__ADZ05858

SEQ ID NO: 20439 - protein, 469 aa, Artificial Sequence; identical to SEQ ID NO: 16738
  neuraminidase__InfluenzaA__ADZ47841

SEQ ID NO: 20440 - protein, 469 aa, Artificial Sequence; identical to SEQ ID NO: 16738
  neuraminidase__InfluenzaA__ADZ47851

SEQ ID NO: 20441 - protein, 469 aa, Artificial Sequence
  neuraminidase__InfluenzaA__ADZ47861
MNPNQKIITIGSVCMTIGLANLILQIGNIISIWISHSIQLGNQNQIETCNQSVITYENNTWVNQTYVNISNINFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDKNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20442 - protein, 470 aa, Artificial Sequence
  neuraminidase__InfluenzaA__ADZ53101
MNPNQKIITIGSISIAIGIISLMLQIGNIISIWASHSIQTGSQNNTGICNQRIITYENSTWVNHTYVNINNTKVVAGEDKTSVTLAGNSSLCSISGWAINTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20443 - protein, 469 aa, Artificial Sequence
  neuraminidase__InfluenzaA__ADZ53124
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNDFSIKQDIVGINEWSGYSGSFVQHPELTGLDCIRPCFWVELIRGRPKENTIWTSGSSISFCGVNSDTVGWSWPDGAELPFTIDK

SEQ ID NO: 20444 - protein, 469 aa, Artificial Sequence; identical to SEQ ID NO: 16738
  neuraminidase__InfluenzaA__ADZ53130

SEQ ID NO: 20445 - protein, 469 aa, Artificial Sequence; identical to SEQ ID NO: 16728
  neuraminidase__InfluenzaA__ADZ53132

SEQ ID NO: 20446 - protein, 469 aa, Artificial Sequence; identical to SEQ ID NO: 16738
  neuraminidase__InfluenzaA__ADZ53134

SEQ ID NO: 20447 - protein, 469 aa, Artificial Sequence; identical to SEQ ID NO: 16738
  neuraminidase__InfluenzaA__ADZ53136

SEQ ID NO: 20448 - protein, 469 aa, Artificial Sequence; identical to SEQ ID NO: 17092
  neuraminidase__InfluenzaA__ADZ53137

SEQ ID NO: 20449 - protein, 469 aa, Artificial Sequence; identical to SEQ ID NO: 16738
  neuraminidase__InfluenzaA__ADZ53139

SEQ ID NO: 20450 - protein, 469 aa, Artificial Sequence
  neuraminidase__InfluenzaA__ADZ53141
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNDFSIKQDIVGINEWSGYSGSFVQHSELTGLDCIRPCFWVELIRGRPKENTIWTSGSSISFCGVNSDTVGWSWPDGAELPFTIDK

SEQ ID NO: 20451 - protein, 469 aa, Artificial Sequence; identical to SEQ ID NO: 16599
  neuraminidase__InfluenzaA__AEA03712

SEQ ID NO: 20452 - protein, 469 aa, Artificial Sequence; identical to SEQ ID NO: 16599
  neuraminidase__InfluenzaA__AEA03722

SEQ ID NO: 20453 - protein, 469 aa, Artificial Sequence; identical to SEQ ID NO: 16599
  neuraminidase__InfluenzaA__AEA03744

SEQ ID NO: 20454 - protein, 469 aa, Artificial Sequence
  neuraminidase__InfluenzaA__AEA03755
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRGRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20455 - protein, 469 aa, Artificial Sequence; identical to SEQ ID NO: 16599
  neuraminidase__InfluenzaA__AEA03766

SEQ ID NO: 20456 - protein, 469 aa, Artificial Sequence; identical to SEQ ID NO: 16599
  neuraminidase__InfluenzaA__AEA03796

SEQ ID NO: 20457 - protein, 469 aa, Artificial Sequence; identical to SEQ ID NO: 16599
  neuraminidase__InfluenzaA__AEA03806

SEQ ID NO: 20458 - protein, 469 aa, Artificial Sequence
  neuraminidase__InfluenzaA__AEA03817
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDRCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20459 - protein, 469 aa, Artificial Sequence; identical to SEQ ID NO: 16599
  neuraminidase__InfluenzaA__AEA03828

SEQ ID NO: 20460 - protein, 469 aa, Artificial Sequence; identical to SEQ ID NO: 16599
  neuraminidase__InfluenzaA__AEA03838

SEQ ID NO: 20461 - protein, 469 aa, Artificial Sequence; identical to SEQ ID NO: 19755
  neuraminidase__InfluenzaA__AEA03849

SEQ ID NO: 20462 - protein, 469 aa, Artificial Sequence; identical to SEQ ID NO: 16599
  neuraminidase__InfluenzaA__AEA03860

SEQ ID NO: 20463 - protein, 469 aa, Artificial Sequence
  neuraminidase__InfluenzaA__AEA03871
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVITDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20464 - protein, 469 aa, Artificial Sequence; identical to SEQ ID NO: 16599
  neuraminidase__InfluenzaA__AEA03879

SEQ ID NO: 20465 - protein, 469 aa, Artificial Sequence
  neuraminidase__InfluenzaA__AEA03889
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNKVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20466 - protein, 469 aa, Artificial Sequence
  neuraminidase__InfluenzaA__AEA03898
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKSDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20467 - protein, 469 aa, Artificial Sequence; identical to SEQ ID NO: 16599
  neuraminidase__InfluenzaA__AEA03909

SEQ ID NO: 20468 - protein, 469 aa, Artificial Sequence
  neuraminidase__InfluenzaA__AEA03924
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIIHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20469 - protein, 469 aa, Artificial Sequence; identical to SEQ ID NO: 16599
  neuraminidase__InfluenzaA__AEA03935

SEQ ID NO: 20470 - protein, 469 aa, Artificial Sequence
  neuraminidase__InfluenzaA__AEA03946
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSEEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20471 - protein, 469 aa, Artificial Sequence
  neuraminidase__InfluenzaA__AEA03957
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNSKSKLQINRQVIVDRGNRSGYSGIFSVEGKSCINRCFYVELIRGRKEETEVLWTSNSIVVFCGTSGTYGTGSWPDGADINLMPI

SEQ ID NO: 20472 - protein, 469 aa, Artificial Sequence; identical to SEQ ID NO: 16599
  neuraminidase__InfluenzaA__AEA03989

SEQ ID NO: 20473 - protein, 469 aa, Artificial Sequence; identical to SEQ ID NO: 19755
  neuraminidase__InfluenzaA__AEA04000

SEQ ID NO: 20474 - protein, 469 aa, Artificial Sequence; identical to SEQ ID NO: 16599
  neuraminidase__InfluenzaA__AEA04011

SEQ ID NO: 20475 - protein, 469 aa, Artificial Sequence; identical to SEQ ID NO: 19755
  neuraminidase__InfluenzaA__AEA04022

SEQ ID NO: 20476 - protein, 469 aa, Artificial Sequence; identical to SEQ ID NO: 16599
  neuraminidase__InfluenzaA__AEA04033

SEQ ID NO: 20477 - protein, 469 aa, Artificial Sequence; identical to SEQ ID NO: 16599
  neuraminidase__InfluenzaA__AEA04044

SEQ ID NO: 20478 - protein, 469 aa, Artificial Sequence; identical to SEQ ID NO: 16599
  neuraminidase__InfluenzaA__AEA04049

SEQ ID NO: 20479 - protein, 469 aa, Artificial Sequence; identical to SEQ ID NO: 16599
  neuraminidase__InfluenzaA__AEA04059

SEQ ID NO: 20480 - protein, 469 aa, Artificial Sequence; identical to SEQ ID NO: 16599
  neuraminidase__InfluenzaA__AEA04070

SEQ ID NO: 20481 - protein, 469 aa, Artificial Sequence; identical to SEQ ID NO: 19755
  neuraminidase__InfluenzaA__AEA04081

SEQ ID NO: 20482 - protein, 469 aa, Artificial Sequence; identical to SEQ ID NO: 16599
  neuraminidase__InfluenzaA__AEA04092

SEQ ID NO: 20483 - protein, 469 aa, Artificial Sequence; identical to SEQ ID NO: 16599
  neuraminidase__InfluenzaA__AEA04103

SEQ ID NO: 20484 - protein, 469 aa, Artificial Sequence; identical to SEQ ID NO: 16599
  neuraminidase__InfluenzaA__AEA04125

SEQ ID NO: 20485 - protein, 469 aa, Artificial Sequence; identical to SEQ ID NO: 16599
  neuraminidase__InfluenzaA__AEA04133

SEQ ID NO: 20486 - protein, 469 aa, Artificial Sequence
  neuraminidase__InfluenzaA__AEA04144
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIIHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIIVFCGTSGTYGTGSWPDGADINLMPI

SEQ ID NO: 20487 - protein, 469 aa, Artificial Sequence; identical to SEQ ID NO: 16599
  neuraminidase__InfluenzaA__AEA04155

SEQ ID NO: 20488 - protein, 469 aa, Artificial Sequence; identical to SEQ ID NO: 16599
  neuraminidase__InfluenzaA__AEA04166

SEQ ID NO: 20489 - protein, 469 aa, Artificial Sequence
  neuraminidase__InfluenzaA__AEA04177
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRNRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20490 - protein, 469 aa, Artificial Sequence; identical to SEQ ID NO: 16599
  neuraminidase__InfluenzaA__AEA04188

SEQ ID NO: 20491 - protein, 469 aa, Artificial Sequence; identical to SEQ ID NO: 17592
  neuraminidase__InfluenzaA__AEA04199

SEQ ID NO: 20492 - protein, 469 aa, Artificial Sequence; identical to SEQ ID NO: 16599
  neuraminidase__InfluenzaA__AEA04210

SEQ ID NO: 20493 - protein, 469 aa, Artificial Sequence; identical to SEQ ID NO: 17592
  neuraminidase__InfluenzaA__AEA04229

SEQ ID NO: 20494 - protein, 469 aa, Artificial Sequence; identical to SEQ ID NO: 17592
  neuraminidase__InfluenzaA__AEA04239

SEQ ID NO: 20495 - protein, 469 aa, Artificial Sequence
  neuraminidase__InfluenzaA__AEA04250
MNPNQKIITIGSVSLTISTICFFMQTAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRVRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20496 - protein, 469 aa, Artificial Sequence; identical to SEQ ID NO: 17592
  neuraminidase__InfluenzaA__AEA04260

SEQ ID NO: 20497 - protein, 469 aa, Artificial Sequence
  neuraminidase__InfluenzaA__AEA04268
MNPNQKIITIGSVSLTISTICLFMQTAILITTVTLHFKQCEFNSPPNNQAMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20498 - protein, 469 aa, Artificial Sequence; identical to SEQ ID NO: 17592
  neuraminidase__InfluenzaA__AEA04276

SEQ ID NO: 20499 - protein, 469 aa, Artificial Sequence; identical to SEQ ID NO: 17592
  neuraminidase__InfluenzaA__AEA04287

SEQ ID NO: 20500 - protein, 469 aa, Artificial Sequence; identical to SEQ ID NO: 17592
  neuraminidase__InfluenzaA__AEA04298

SEQ ID NO: 20501 - protein, 469 aa, Artificial Sequence
  neuraminidase__InfluenzaA__AEA04307
MNPNQKIITIGSVSLTISTICFFMQTAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPDVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20502 - protein, 464 aa, Artificial Sequence
  neuraminidase__InfluenzaA__AEA04357
MNPNQKIITIGSICMVVGIISLILQIGNIVSIWISHSIQTGNQNHTGTCDQSIITYKNSTWVNQTYVNVVAGKDTTSVILAGNSSLCPIRGWAIYSKDNGVRIGSKGDVFVIREPFISCSHLECRTFFLTQGALLNDKHSNGTVKDRSPYRALMSCPVGEAPSPYNSRFESVAWSASACHDGMGWLTIGISGPDDGAVAVLKYNGIITETIKSWRKEILRTQESECVCVNGSCFTIMTDGPSGGPASYKIFKIEKGKVTKSIELDAPNSHYEECSCYPDTSKVMCVCRDNWHGSNRPWVSFDQNLDYQMGYICSGVFGDNPRPKDGKGSCGPVYVDGANGVKGFSYKYGNGVWIGRTKSISSRQGFEMIWDPNGWTETDSNFFTKQDVVAVTDWSGYSGSFVQHPELTGLDCMRPCFWVELIRGRPKENTIWTSGSSISFCGVNSDTVDWSWPDGAELPFTIDK

SEQ ID NO: 20503 - protein, 469 aa, Artificial Sequence; identical to SEQ ID NO: 16467
  neuraminidase__InfluenzaA__AEA04368

SEQ ID NO: 20504 - protein, 469 aa, Artificial Sequence
  neuraminidase__InfluenzaA__AEA04379
MNPNQKTITIGSVSLTIETVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSKSRDPNNERGNPGVKGWAFDNGDDVWMGRTISKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 20505 - protein, 470 aa, Artificial Sequence; identical to SEQ ID NO: 20204
  neuraminidase__InfluenzaA__AEA10295

SEQ ID NO: 20506 - protein, 469 aa, Artificial Sequence; identical to SEQ ID NO: 16738
  neuraminidase__InfluenzaA__AEA10306

SEQ ID NO: 20507 - protein, 469 aa, Artificial Sequence; identical to SEQ ID NO: 20091
  neuraminidase__InfluenzaA__AEA10316

SEQ ID NO: 20508 - protein, 469 aa, Artificial Sequence; identical to SEQ ID NO: 16738
  neuraminidase__InfluenzaA__AEA10326

SEQ ID NO: 20509 - protein, 469 aa, Artificial Sequence; identical to SEQ ID NO: 18026
  neuraminidase__InfluenzaA__AEA10335

SEQ ID NO: 20510 - protein, 469 aa, Artificial Sequence; identical to SEQ ID NO: 16738
  neuraminidase__InfluenzaA__AEA10342

SEQ ID NO: 20511 - protein, 469 aa, Artificial Sequence
  neuraminidase__InfluenzaA__AEA10352
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACINGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCSPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20512 - protein, 469 aa, Artificial Sequence; identical to SEQ ID NO: 16738
  neuraminidase__InfluenzaA__AEA48991

SEQ ID NO: 20513 - protein, 469 aa, Artificial Sequence; identical to SEQ ID NO: 19410
  neuraminidase__InfluenzaA__AEA72707

SEQ ID NO: 20514 - protein, 469 aa, Artificial Sequence; identical to SEQ ID NO: 19410
  neuraminidase__InfluenzaA__AEA72718

SEQ ID NO: 20515 - protein, 469 aa, Artificial Sequence; identical to SEQ ID NO: 19410
  neuraminidase__InfluenzaA__AEA72729

SEQ ID NO: 20516 - protein, 469 aa, Artificial Sequence
  neuraminidase__InfluenzaA__AEA72742
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20517 - protein, 469 aa, Artificial Sequence; identical to SEQ ID NO: 19013
  neuraminidase__InfluenzaA__AEA72779

SEQ ID NO: 20518 - protein, 469 aa, Artificial Sequence
  neuraminidase__InfluenzaA__AEA72789
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDDSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20519 - protein, 469 aa, Artificial Sequence; identical to SEQ ID NO: 19410
  neuraminidase__InfluenzaA__AEA73291

SEQ ID NO: 20520 - protein, 469 aa, Artificial Sequence; identical to SEQ ID NO: 19410
  neuraminidase__InfluenzaA__AEA73302

SEQ ID NO: 20521 - protein, 469 aa, Artificial Sequence; identical to SEQ ID NO: 19410
  neuraminidase__InfluenzaA__AEA73313

SEQ ID NO: 20522 - protein, 469 aa, Artificial Sequence; identical to SEQ ID NO: 19410
  neuraminidase__InfluenzaA__AEA73324

SEQ ID NO: 20523 - protein, 469 aa, Artificial Sequence; identical to SEQ ID NO: 19410
  neuraminidase__InfluenzaA__AEA73335

SEQ ID NO: 20524 - protein, 469 aa, Artificial Sequence; identical to SEQ ID NO: 19410
  neuraminidase__InfluenzaA__AEA73346

SEQ ID NO: 20525 - protein, 469 aa, Artificial Sequence; identical to SEQ ID NO: 19410
  neuraminidase__InfluenzaA__AEA73357

SEQ ID NO: 20526 - protein, 469 aa, Artificial Sequence; identical to SEQ ID NO: 19410
  neuraminidase__InfluenzaA__AEA73368

SEQ ID NO: 20527 - protein, 469 aa, Artificial Sequence; identical to SEQ ID NO: 19410
  neuraminidase__InfluenzaA__AEA73379

SEQ ID NO: 20528 - protein, 469 aa, Artificial Sequence; identical to SEQ ID NO: 19410
  neuraminidase__InfluenzaA__AEA73390

SEQ ID NO: 20529 - protein, 469 aa, Artificial Sequence; identical to SEQ ID NO: 19410
  neuraminidase__InfluenzaA__AEA73401

SEQ ID NO: 20530 - protein, 469 aa, Artificial Sequence; identical to SEQ ID NO: 19410
  neuraminidase__InfluenzaA__AEA73412

SEQ ID NO: 20531 - protein, 469 aa, Artificial Sequence; identical to SEQ ID NO: 19410
  neuraminidase__InfluenzaA__AEA73423

SEQ ID NO: 20532 - protein, 469 aa, Artificial Sequence; identical to SEQ ID NO: 19410
  neuraminidase__InfluenzaA__AEA73455

SEQ ID NO: 20533 - protein, 469 aa, Artificial Sequence; identical to SEQ ID NO: 19410
  neuraminidase__InfluenzaA__AEA73466

SEQ ID NO: 20534 - protein, 469 aa, Artificial Sequence
  neuraminidase__InfluenzaA__AEA73477
MNPNQKIITIGSVSLTISTICFFMQIAILITTVTLHFKQYKFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETKVLWTSNSIVVFCGTSGTYGTGSWPDGADLNLMPI

SEQ ID NO: 20535 - protein, 469 aa, Artificial Sequence; identical to SEQ ID NO: 19410
  neuraminidase__InfluenzaA__AEA73488

SEQ ID NO: 20536 - protein, 469 aa, Artificial Sequence
  neuraminidase__InfluenzaA__AEA73499
MNPNQKIITIGSVSLTISTICFFMQIAILITTVTLHFKQYKFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTINNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20537 - protein, 469 aa, Artificial Sequence; identical to SEQ ID NO: 19410
  neuraminidase__InfluenzaA__AEA73510

SEQ ID NO: 20538 - protein, 469 aa, Artificial Sequence; identical to SEQ ID NO: 19410
  neuraminidase__InfluenzaA__AEA73521

SEQ ID NO: 20539 - protein, 469 aa, Artificial Sequence; identical to SEQ ID NO: 19410
  neuraminidase__InfluenzaA__AEA73532

SEQ ID NO: 20540 - protein, 469 aa, Artificial Sequence; identical to SEQ ID NO: 19410
  neuraminidase__InfluenzaA__AEA73543

SEQ ID NO: 20541 - protein, 469 aa, Artificial Sequence; identical to SEQ ID NO: 19410
  neuraminidase__InfluenzaA__AEA73554

SEQ ID NO: 20542 - protein, 469 aa, Artificial Sequence; identical to SEQ ID NO: 19410
  neuraminidase__InfluenzaA__AEA73565

SEQ ID NO: 20543 - protein, 470 aa, Artificial Sequence; identical to SEQ ID NO: 17461
  neuraminidase__InfluenzaA__AEA73576

SEQ ID NO: 20544 - protein, 470 aa, Artificial Sequence; identical to SEQ ID NO: 17461
  neuraminidase__InfluenzaA__AEA73587

SEQ ID NO: 20545 - protein, 470 aa, Artificial Sequence; identical to SEQ ID NO: 20204
  neuraminidase__InfluenzaA__AEA73598

SEQ ID NO: 20546 - protein, 470 aa, Artificial Sequence; identical to SEQ ID NO: 17461
  neuraminidase__InfluenzaA__AEA73609

SEQ ID NO: 20547 - protein, 470 aa, Artificial Sequence; identical to SEQ ID NO: 17461
  neuraminidase__InfluenzaA__AEA73620

SEQ ID NO: 20548 - protein, 470 aa, Artificial Sequence
  neuraminidase__InfluenzaA__AEA73631
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRIKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20549 - protein, 470 aa, Artificial Sequence
  neuraminidase__InfluenzaA__AEA73642
MNPNQRIITIGSISIAIGIISLMLQIGNIISIWASHSIQTGSQNNTGICKQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWLGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20550 - protein, 470 aa, Artificial Sequence; identical to SEQ ID NO: 17461
  neuraminidase__InfluenzaA__AEA73653

SEQ ID NO: 20551 - protein, 470 aa, Artificial Sequence
  neuraminidase__InfluenzaA__AEA73664
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVNGADGVKGFSYKYGNGVWIGRTKSNRLRKGFEMIWDPNGWTNTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 20552 - protein, 470 aa, Artificial Sequence
  neuraminidase__InfluenzaA__AEA73675
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWIELVRGLPRENTTIWTSGSSISFCGVNSDTANWSWPDGAELPFTIDK

SEQ ID NO: 20553 - protein, 470 aa, Artificial Sequence; identical to SEQ ID NO: 20204
  neuraminidase__InfluenzaA__AEA73686

SEQ ID NO: 20554 - protein, 470 aa, Artificial Sequence
  neuraminidase__InfluenzaA__AEA73697
MNPNQKIITIGSISIAIGIISLMLQIGNIISIWASHSIQTGSQNNTGICNQRIITYENSTWVNHTYVNINNTNIVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSVELNAPNFYYEECSCYPDTGIVMCVCRDNWHGSNRPWVSFNQNLDYQIGYICSGVFGDNPRPEDGEGSCNPVTVNGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20555 - protein, 470 aa, Artificial Sequence; identical to SEQ ID NO: 20205
  neuraminidase__InfluenzaA__AEA73708

SEQ ID NO: 20556 - protein, 470 aa, Artificial Sequence; identical to SEQ ID NO: 17461
  neuraminidase__InfluenzaA__AEA73719

SEQ ID NO: 20557 - protein, 470 aa, Artificial Sequence; identical to SEQ ID NO: 17461
  neuraminidase__InfluenzaA__AEA73730

SEQ ID NO: 20558 - protein, 470 aa, Artificial Sequence; identical to SEQ ID NO: 17461
  neuraminidase__InfluenzaA__AEA73741

SEQ ID NO: 20559 - protein, 470 aa, Artificial Sequence; identical to SEQ ID NO: 17461
  neuraminidase__InfluenzaA__AEA73752

SEQ ID NO: 20560 - protein, 470 aa, Artificial Sequence; identical to SEQ ID NO: 20204
  neuraminidase__InfluenzaA__AEA73763

SEQ ID NO: 20561 - protein, 469 aa, Artificial Sequence; identical to SEQ ID NO: 16738
  neuraminidase__InfluenzaA__AEA73774

SEQ ID NO: 20562 - protein, 469 aa, Artificial Sequence; identical to SEQ ID NO: 16738
  neuraminidase__InfluenzaA__AEA73784

SEQ ID NO: 20563 - protein, 469 aa, Artificial Sequence; identical to SEQ ID NO: 16738
  neuraminidase__InfluenzaA__AEA73794

SEQ ID NO: 20564 - protein, 469 aa, Artificial Sequence; identical to SEQ ID NO: 16738
  neuraminidase__InfluenzaA__AEA73804

SEQ ID NO: 20565 - protein, 469 aa, Artificial Sequence; identical to SEQ ID NO: 16738
  neuraminidase__InfluenzaA__AEA73814

SEQ ID NO: 20566 - protein, 469 aa, Artificial Sequence; identical to SEQ ID NO: 16738
  neuraminidase__InfluenzaA__AEA73824

SEQ ID NO: 20567 - protein, 469 aa, Artificial Sequence
  neuraminidase__InfluenzaA__AEA73834
MNPNQKIITIGSICMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWKNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20568 - protein, 469 aa, Artificial Sequence; identical to SEQ ID NO: 20100
  neuraminidase__InfluenzaA__AEA73844

SEQ ID NO: 20569 - protein, 469 aa, Artificial Sequence; identical to SEQ ID NO: 16738
  neuraminidase__InfluenzaA__AEA73854

SEQ ID NO: 20570 - protein, 469 aa, Artificial Sequence; identical to SEQ ID NO: 16738
  neuraminidase__InfluenzaA__AEA73864

SEQ ID NO: 20571 - protein, 469 aa, Artificial Sequence; identical to SEQ ID NO: 18519
  neuraminidase__InfluenzaA__AEA73874

SEQ ID NO: 20572 - protein, 469 aa, Artificial Sequence; identical to SEQ ID NO: 18519
  neuraminidase__InfluenzaA__AEA73884

SEQ ID NO: 20573 - protein, 469 aa, Artificial Sequence; identical to SEQ ID NO: 20100
  neuraminidase__InfluenzaA__AEA73894

SEQ ID NO: 20574 - protein, 469 aa, Artificial Sequence
  neuraminidase__InfluenzaA__AEA73904
MNPNQKIITIGSVCMTIGMANLVLQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKEKTIWTSGSSISFCGVNSDTVGWSWPDGAELPFTIDK

SEQ ID NO: 20575 - protein, 469 aa, Artificial Sequence; identical to SEQ ID NO: 16738
  neuraminidase__InfluenzaA__AEA73914

SEQ ID NO: 20576 - protein, 469 aa, Artificial Sequence; identical to SEQ ID NO: 18519
  neuraminidase__InfluenzaA__AEA73924

SEQ ID NO: 20577 - protein, 469 aa, Artificial Sequence; identical to SEQ ID NO: 20177
  neuraminidase__InfluenzaA__AEA73934

SEQ ID NO: 20578 - protein, 469 aa, Artificial Sequence
  neuraminidase__InfluenzaA__AEA73944
MNPNQKIITIGSVCMTIGMANLILQVGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20579 - protein, 469 aa, Artificial Sequence; identical to SEQ ID NO: 16738
  neuraminidase__InfluenzaA__AEA73954

SEQ ID NO: 20580 - protein, 469 aa, Artificial Sequence; identical to SEQ ID NO: 16738
  neuraminidase__InfluenzaA__AEA73964

SEQ ID NO: 20581 - protein, 469 aa, Artificial Sequence
  neuraminidase__InfluenzaA__AEA73974
MNPNQKIITIGSVCMTIGMANLILQIGNIISIWISHSIQHGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20582 - protein, 469 aa, Artificial Sequence; identical to SEQ ID NO: 16738
  neuraminidase__InfluenzaA__AEA73984

SEQ ID NO: 20583 - protein, 469 aa, Artificial Sequence; identical to SEQ ID NO: 18089
  neuraminidase__InfluenzaA__AEA73994

SEQ ID NO: 20584 - protein, 469 aa, Artificial Sequence
  neuraminidase__InfluenzaA__AEA74004
MNPNKKIIIIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20585 - protein, 469 aa, Artificial Sequence; identical to SEQ ID NO: 17915
  neuraminidase__InfluenzaA__AEA74014

SEQ ID NO: 20586 - protein, 469 aa, Artificial Sequence; identical to SEQ ID NO: 17915
  neuraminidase__InfluenzaA__AEA74024

SEQ ID NO: 20587 - protein, 469 aa, Artificial Sequence; identical to SEQ ID NO: 16738
  neuraminidase__InfluenzaA__AEA74032

SEQ ID NO: 20588 - protein, 469 aa, Artificial Sequence; identical to SEQ ID NO: 16738
  neuraminidase__InfluenzaA__AEA74034

SEQ ID NO: 20589 - protein, 469 aa, Artificial Sequence
  neuraminidase__InfluenzaA__AEA77302
MNPNQKIITIGSVSLTISTICFFMQIAILITTVTLHFKQYEFNSPPNNQVMLCEPTIIERNITEIVYLTNTTIEKEKCPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPKKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20590 - protein, 469 aa, Artificial Sequence; identical to SEQ ID NO: 20257
  neuraminidase__InfluenzaA__AEB21318

SEQ ID NO: 20591 - protein, 469 aa, Artificial Sequence
  neuraminidase__InfluenzaA__AEB21328
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGFNWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSMSFCGVNSDTVGWSWPDGAELPFTIDK

SEQ ID NO: 20592 - protein, 469 aa, Artificial Sequence; identical to SEQ ID NO: 20257
  neuraminidase__InfluenzaA__AEB21340

SEQ ID NO: 20593 - protein, 469 aa, Artificial Sequence
  neuraminidase__InfluenzaA__AEB21350
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPSECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSIISRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20594 - protein, 469 aa, Artificial Sequence; identical to SEQ ID NO: 20257
  neuraminidase__InfluenzaA__AEB21360

SEQ ID NO: 20595 - protein, 469 aa, Artificial Sequence; identical to SEQ ID NO: 17605
  neuraminidase__InfluenzaA__AEB40209

SEQ ID NO: 20596 - protein, 469 aa, Artificial Sequence; identical to SEQ ID NO: 16599
  neuraminidase__InfluenzaA__AEB66898

SEQ ID NO: 20597 - protein, 470 aa, Artificial Sequence
  neuraminidase__InfluenzaA__AEB71103
MNPNQKIITIGSVSLGLVVFNVLLHVVSIIVTVVVLGNDGGNGICNGTVVKEYNETVRIERVIQWHNTSVVEYIPYLNGGTYTNNTESVCDVKGFAPFSKDNGVRIGSRGHVFVIREPFVSCSPRECRTFFLTQGSLLNDKHSNGTVKDRSPFKTLMSVEVGQSPNVYQARFEAVAWSATACHDGKKWMTIGVTGPDSKAVAVVHYGGVPTDIINSWAGDILRTQESSCTCIQGDCYWVMTDGPANRQAQYRIYKSNQGKIIGQMDINFNGGHIEECSCYPNDGKVECVCRDNWTGTNRPVLVISPDLSYKVGYLCAGLPSDTPRGEDAQFSGSCTSPVGGQGYGVKGFGFRQGNDVWMGRTISRTSRSGFEVIRVKNGWTQTSKEQIRKQVVVDNLNWSGYSGSFTLPIELSGKSCLVPCFWVETIRGKPEEKTIWTSSSSIVMCGVDYEVADWSWHDGAILPFDIDKM

SEQ ID NO: 20598 - protein, 470 aa, Artificial Sequence; identical to SEQ ID NO: 18930
  neuraminidase__InfluenzaA__AEB71899

SEQ ID NO: 20599 - protein, 469 aa, Artificial Sequence
  neuraminidase__InfluenzaA__AEB71910
MNPNQKIITIGSVCMTIGMANLILQIGNIISIWISHSIQLGNQNQIETCNQSVITYENNTWVNQTYVNISNTYFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20600 - protein, 469 aa, Artificial Sequence; identical to SEQ ID NO: 16738
  neuraminidase__InfluenzaA__AEB71919

SEQ ID NO: 20601 - protein, 469 aa, Artificial Sequence; identical to SEQ ID NO: 18484
  neuraminidase__InfluenzaA__AEB71928

SEQ ID NO: 20602 - protein, 469 aa, Artificial Sequence
  neuraminidase__InfluenzaA__AEB71939
MNPNQKIITIGSVSLTISAICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20603 - protein, 469 aa, Artificial Sequence
  neuraminidase__InfluenzaA__AEB71950
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGDHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20604 - protein, 470 aa, Artificial Sequence; identical to SEQ ID NO: 19937
  neuraminidase__InfluenzaA__AEB71961

SEQ ID NO: 20605 - protein, 469 aa, Artificial Sequence
  neuraminidase__InfluenzaA__AEB71972
MNPNQKIITIGSVSLTISTICFFMQIAILITTVTLHFKQYEFNSPPNNQVMLCEPTIIERNITEIVYLTNTTIVKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20606 - protein, 469 aa, Artificial Sequence
  neuraminidase__InfluenzaA__AEB71983
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRRNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20607 - protein, 470 aa, Artificial Sequence
  neuraminidase__InfluenzaA__AEB71995
MNPNQKIITIGSISIAIGIISLMLQIGNIISIWASHSIQTGSQNNTGICNQRIITYENSTWVNHTYININNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVNGADGVKGFSYKYGNGVWIGRTKSNRLRKGFEMIWDPNGWTNTDSDFSVKQDVVAITDWSGYSGSFVQHPELTGLECIRPCFWVELVRGLPRENTTIWTSGSSISFCGVNSDTANWSWPDGAELPFTIDK

SEQ ID NO: 20608 - protein, 470 aa, Artificial Sequence; identical to SEQ ID NO: 20205
  neuraminidase__InfluenzaA__AEC13316

SEQ ID NO: 20609 - protein, 469 aa, Artificial Sequence; identical to SEQ ID NO: 16738
  neuraminidase__InfluenzaA__AEC53262

SEQ ID NO: 20610 - protein, 469 aa, Artificial Sequence; identical to SEQ ID NO: 16738
  neuraminidase__InfluenzaA__AEC53272

SEQ ID NO: 20611 - protein, 469 aa, Artificial Sequence; identical to SEQ ID NO: 16738
  neuraminidase__InfluenzaA__AEC53282

SEQ ID NO: 20612 - protein, 469 aa, Artificial Sequence; identical to SEQ ID NO: 16738
  neuraminidase__InfluenzaA__AEC53292

SEQ ID NO: 20613 - protein, 469 aa, Artificial Sequence
  neuraminidase__InfluenzaA__AEC53302
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDIIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20614 - protein, 469 aa, Artificial Sequence; identical to SEQ ID NO: 16738
  neuraminidase__InfluenzaA__AEC53350

SEQ ID NO: 20615 - protein, 469 aa, Artificial Sequence; identical to SEQ ID NO: 17446
  neuraminidase__InfluenzaA__AEC53407

SEQ ID NO: 20616 - protein, 469 aa, Artificial Sequence; identical to SEQ ID NO: 16738
  neuraminidase__InfluenzaA__AEC53427

SEQ ID NO: 20617 - protein, 469 aa, Artificial Sequence; identical to SEQ ID NO: 17564
  neuraminidase__InfluenzaA__AED99967

SEQ ID NO: 20618 - protein, 469 aa, Artificial Sequence; identical to SEQ ID NO: 16728
  neuraminidase__InfluenzaA__AEE27161

SEQ ID NO: 20619 - protein, 469 aa, Artificial Sequence; identical to SEQ ID NO: 16738
  neuraminidase__InfluenzaA__AEE27170

SEQ ID NO: 20620 - protein, 469 aa, Artificial Sequence; identical to SEQ ID NO: 16728
  neuraminidase__InfluenzaA__AEE27180

SEQ ID NO: 20621 - protein, 469 aa, Artificial Sequence
  neuraminidase__InfluenzaA__AEE27190
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGVITDTIKSWRNNILRTQESECACVNGSCFTVMTDGPSNGQASYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20622 - protein, 469 aa, Artificial Sequence; identical to SEQ ID NO: 17961
  neuraminidase__InfluenzaA__AEE27200

SEQ ID NO: 20623 - protein, 469 aa, Artificial Sequence; identical to SEQ ID NO: 19797
  neuraminidase__InfluenzaA__AEG64755

SEQ ID NO: 20624 - protein, 453 aa, Artificial Sequence
  neuraminidase__InfluenzaA__AEG64765
MNPNQKIITIGSICMVVGIISLILQIGNIISIWISHSIQTGNQNHTGICNQGIITYNVVAGQDSTSVILTGNSSLCPIRGWAIHSKDNGIRIGSKGDVFVIREPFISCSHLECRTFFLTQGALLNDKHSNGTVKDRSPYRALMSCPVGEAPSPYNSRFESVAWSASACHDGMGWLTIGISGPDNGAVAVLKYNGIITETIKSWRKKILRTQESECTCVNGSCFTIMTDGPSDGLASYKIFKIEKGKVTKSIELNAPNSHYEECSCYPDTGKVMCVCRDNWHGSNRPWVSFDQNLDYQIGYICSGVFGDNPRPKDGTGSCGPVSADGANGVKGFSYRYGNGVWIGRTKSDSSRHGFEMIWDPNGWTETDSRFSVRQDVVAMTDRSGYSGSFVQHPELTGLDCMRPCFWVELIRGRPEEKTIWTSGSIISFCGVNSDTVDWSWPDGAELPFTIDK

SEQ ID NO: 20625 - protein, 469 aa, Artificial Sequence
  neuraminidase__InfluenzaA__AEG64787
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNRLRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNDFSIKQDIVGINEWSGYSGSFVQHPELTGLDCIRPCFWVELIRGRPKENTIWTSGSSISFCGVNSDTVGWSWPDGAELPFTIDK

SEQ ID NO: 20626 - protein, 469 aa, Artificial Sequence
  neuraminidase__InfluenzaA__AEG64837
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASLIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20627 - protein, 469 aa, Artificial Sequence
  neuraminidase__InfluenzaA__AEG64848
MNPNQKIITIGSVSLTISTICFFMQIAILITTVTLHFKQYEFYSPPNNQVMLCEPTIIERNITEIVYLTNTTIEKEICPKLAEYRNWLKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINKQVIVDRGNRSGYSGIFSVEGKSCINRCFYVELIRGRKEETEVLWTSNSIVVFCGTSGTYGTGSWPDGADLNLMPI

SEQ ID NO: 20628 - protein, 469 aa, Artificial Sequence; identical to SEQ ID NO: 14233
  neuraminidase__InfluenzaA__AEG64859

SEQ ID NO: 20629 - protein, 469 aa, Artificial Sequence; identical to SEQ ID NO: 14061
  neuraminidase__InfluenzaA__AEG64870

SEQ ID NO: 20630 - protein, 469 aa, Artificial Sequence; identical to SEQ ID NO: 14253
  neuraminidase__InfluenzaA__AEG64881

SEQ ID NO: 20631 - protein, 469 aa, Artificial Sequence; identical to SEQ ID NO: 14061
  neuraminidase__InfluenzaA__AEG64892

SEQ ID NO: 20632 - protein, 469 aa, Artificial Sequence; identical to SEQ ID NO: 14137
  neuraminidase__InfluenzaA__AEG64914

SEQ ID NO: 20633 - protein, 469 aa, Artificial Sequence; identical to SEQ ID NO: 14137
  neuraminidase__InfluenzaA__AEG64925

SEQ ID NO: 20634 - protein, 469 aa, Artificial Sequence
  neuraminidase__InfluenzaA__AEG64936
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGEDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 20635 - protein, 469 aa, Artificial Sequence; identical to SEQ ID NO: 14150
  neuraminidase__InfluenzaA__AEG64947

SEQ ID NO: 20636 - protein, 469 aa, Artificial Sequence; identical to SEQ ID NO: 14137
  neuraminidase__InfluenzaA__AEG64958

SEQ ID NO: 20637 - protein, 469 aa, Artificial Sequence; identical to SEQ ID NO: 14137
  neuraminidase__InfluenzaA__AEG64969

SEQ ID NO: 20638 - protein, 469 aa, Artificial Sequence; identical to SEQ ID NO: 14137
  neuraminidase__InfluenzaA__AEG64980

SEQ ID NO: 20639 - protein, 469 aa, Artificial Sequence
  neuraminidase__InfluenzaA__AEG64991
MNPNQKIITIGSVSLTISTICFFMQIAILITTVTLHFKQYESNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 20640 - protein, 469 aa, Artificial Sequence; identical to SEQ ID NO: 14327
  neuraminidase__InfluenzaA__AEG65002

SEQ ID NO: 20641 - protein, 469 aa, Artificial Sequence
  neuraminidase__InfluenzaA__AEG65013
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKDILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQTNRQVIVERGNRSGYSGIFSVEGKSCINRCFYVELIRGRKEETEVLWTSNSIVVFCGTSGTYGTGSWPDGADINLMPI

SEQ ID NO: 20642 - protein, 469 aa, Artificial Sequence
  neuraminidase__InfluenzaA__AEG65024
MNPNQKIITIGSVSLTISTICFFMQIAILITTVTLHFKQYEFNSPPNNHVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 20643 - protein, 469 aa, Artificial Sequence
  neuraminidase__InfluenzaA__AEG65035
MNPNQKIITIGSVSLTISTICFFMQIAILITTVTLHFKQYEFNSPPNNQVMLCEPTIIERNITEIVYLTNTTIEKEVCPKLAEYRNWSKPQCNITGFAPFSKDNSIRLSAGGDIWVTREPYVSCDLDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEENEVLWTSNSIVVFCGTSGTYGTGSWPDGADINLMPI

SEQ ID NO: 20644 - protein, 469 aa, Artificial Sequence; identical to SEQ ID NO: 14712
  neuraminidase__InfluenzaA__AEG65057

SEQ ID NO: 20645 - protein, 469 aa, Artificial Sequence; identical to SEQ ID NO: 15707
  neuraminidase__InfluenzaA__AEG65068

SEQ ID NO: 20646 - protein, 469 aa, Artificial Sequence
  neuraminidase__InfluenzaA__AEG65079
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAKHVEECSCYPRYPGVRCVCRDNWKGSNRPIVDINIKDYSIVSSYVCSGLVGDTPRKNDSSSSGHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 20647 - protein, 469 aa, Artificial Sequence
  neuraminidase__InfluenzaA__AEG65090
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIIHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADISLMPI

SEQ ID NO: 20648 - protein, 469 aa, Artificial Sequence
  neuraminidase__InfluenzaA__AEG65101
MNPNQKIITIGSVSLTISTICFFMQIAILITTVTLHFKQYEFNSPPDNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKNYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 20649 - protein, 469 aa, Artificial Sequence
  neuraminidase__InfluenzaA__AEG65123
MNPNQKIITIGSVSLTISTICFFMQIAILITTVTLHFKQYEFNSPPNNQVMLCEPTTIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKNYSIVSSYVCSGLVGDTPRKTDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEENEVLWTSNSIVVFCGTSGTYGTGSWPDGADINLMPI

SEQ ID NO: 20650 - protein, 469 aa, Artificial Sequence; identical to SEQ ID NO: 15707
  neuraminidase__InfluenzaA__AEG65134

SEQ ID NO: 20651 - protein, 469 aa, Artificial Sequence
  neuraminidase__InfluenzaA__AEG65145
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSNSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 20652 - protein, 469 aa, Artificial Sequence
  neuraminidase__InfluenzaA__AEG65156
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHTSTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 20653 - protein, 469 aa, Artificial Sequence
  neuraminidase__InfluenzaA__AEG65167
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSARHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 20654 - protein, 469 aa, Artificial Sequence
  neuraminidase__InfluenzaA__AEG65178
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNNTVHDRTPYRTLLMNELGVPFHLGTRQVCIAWSSSSCHDGKAWLHVCVTGDDKNATASFIYNGRLVDSIGSWSKNILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 20655 - protein, 469 aa, Artificial Sequence
  neuraminidase__InfluenzaA__AEG65189
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDININDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 20656 - protein, 469 aa, Artificial Sequence
  neuraminidase__InfluenzaA__AEG65200
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEVLRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQTNRQVIVDRGNRSGYSGIFSVEGKSCINRCFYVELIRGRKEETEVLWTSNSIVVFCGTSGTYGTGSWPDGADINLMPI

SEQ ID NO: 20657 - protein, 469 aa, Artificial Sequence; identical to SEQ ID NO: 14712
  neuraminidase__InfluenzaA__AEG65211

SEQ ID NO: 20658 - protein, 469 aa, Artificial Sequence; identical to SEQ ID NO: 14714
  neuraminidase__InfluenzaA__AEG65222

SEQ ID NO: 20659 - protein, 469 aa, Artificial Sequence
  neuraminidase__InfluenzaA__AEG65233
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIIDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 20660 - protein, 469 aa, Artificial Sequence
  neuraminidase__InfluenzaA__AEG65244
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTQQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIASSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRNQETEVLWTSNSIVVFCGTSGTYGTGSWPDGADINLMPI

SEQ ID NO: 20661 - protein, 469 aa, Artificial Sequence; identical to SEQ ID NO: 14714
  neuraminidase__InfluenzaA__AEG65255

SEQ ID NO: 20662 - protein, 469 aa, Artificial Sequence; identical to SEQ ID NO: 14591
  neuraminidase__InfluenzaA__AEG65266

SEQ ID NO: 20663 - protein, 469 aa, Artificial Sequence; identical to SEQ ID NO: 14591
  neuraminidase__InfluenzaA__AEG65277

SEQ ID NO: 20664 - protein, 469 aa, Artificial Sequence
  neuraminidase__InfluenzaA__AEG65288
MNPNQKIITIGSVSLTIATICFLMQIAILVTTVTLHFKQHECNSPPNNQVMLCEPTIIERNITEIVYLTNTTIEKEICPKLVEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNNSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 20665 - protein, 469 aa, Artificial Sequence; identical to SEQ ID NO: 14591
  neuraminidase__InfluenzaA__AEG65299

SEQ ID NO: 20666 - protein, 469 aa, Artificial Sequence; identical to SEQ ID NO: 14714
  neuraminidase__InfluenzaA__AEG65310

SEQ ID NO: 20667 - protein, 469 aa, Artificial Sequence; identical to SEQ ID NO: 14714
  neuraminidase__InfluenzaA__AEG65321

SEQ ID NO: 20668 - protein, 469 aa, Artificial Sequence; identical to SEQ ID NO: 14714
  neuraminidase__InfluenzaA__AEG65332

SEQ ID NO: 20669 - protein, 469 aa, Artificial Sequence; identical to SEQ ID NO: 14714
  neuraminidase__InfluenzaA__AEG65354

SEQ ID NO: 20670 - protein, 469 aa, Artificial Sequence; identical to SEQ ID NO: 14714
  neuraminidase__InfluenzaA__AEG65365

SEQ ID NO: 20671 - protein, 469 aa, Artificial Sequence
  neuraminidase__InfluenzaA__AEG65376
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTQQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRNQETEVLWTSNSIVVFCGTSGTYGTGSWPDGADINLMPI

SEQ ID NO: 20672 - protein, 469 aa, Artificial Sequence; identical to SEQ ID NO: 14591
  neuraminidase__InfluenzaA__AEG65387

SEQ ID NO: 20673 - protein, 469 aa, Artificial Sequence; identical to SEQ ID NO: 14591
  neuraminidase__InfluenzaA__AEG65398

SEQ ID NO: 20674 - protein, 469 aa, Artificial Sequence; identical to SEQ ID NO: 14591
  neuraminidase__InfluenzaA__AEG65409

SEQ ID NO: 20675 - protein, 469 aa, Artificial Sequence; identical to SEQ ID NO: 14591
  neuraminidase__InfluenzaA__AEG65420

SEQ ID NO: 20676 - protein, 469 aa, Artificial Sequence; identical to SEQ ID NO: 14591
  neuraminidase__InfluenzaA__AEG65431

SEQ ID NO: 20677 - protein, 469 aa, Artificial Sequence; identical to SEQ ID NO: 14712
  neuraminidase__InfluenzaA__AEG65442

SEQ ID NO: 20678 - protein, 469 aa, Artificial Sequence; identical to SEQ ID NO: 14714
  neuraminidase__InfluenzaA__AEG65453

SEQ ID NO: 20679 - protein, 469 aa, Artificial Sequence; identical to SEQ ID NO: 14714
  neuraminidase__InfluenzaA__AEG65464

SEQ ID NO: 20680 - protein, 469 aa, Artificial Sequence; identical to SEQ ID NO: 14714
  neuraminidase__InfluenzaA__AEG65475

SEQ ID NO: 20681 - protein, 469 aa, Artificial Sequence
  neuraminidase__InfluenzaA__AEG65486
MNPNQKIITIGSVSLTISTICFFMQIAILITTVTLHFKQYEFNSPPNNQVMLCEPTIIERNITEIVYLTNTTIEKEICPKLAEHRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 20682 - protein, 469 aa, Artificial Sequence; identical to SEQ ID NO: 14714
  neuraminidase__InfluenzaA__AEG65497

SEQ ID NO: 20683 - protein, 469 aa, Artificial Sequence; identical to SEQ ID NO: 14714
  neuraminidase__InfluenzaA__AEG65508

SEQ ID NO: 20684 - protein, 469 aa, Artificial Sequence; identical to SEQ ID NO: 14714
  neuraminidase__InfluenzaA__AEG65519

SEQ ID NO: 20685 - protein, 469 aa, Artificial Sequence; identical to SEQ ID NO: 14714
  neuraminidase__InfluenzaA__AEG65530

SEQ ID NO: 20686 - protein, 469 aa, Artificial Sequence; identical to SEQ ID NO: 14714
  neuraminidase__InfluenzaA__AEG65541

SEQ ID NO: 20687 - protein, 469 aa, Artificial Sequence
  neuraminidase__InfluenzaA__AEG65563
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDRCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 20688 - protein, 469 aa, Artificial Sequence
  neuraminidase__InfluenzaA__AEG65574
MNPNQKIITIGSVSLTISTICFFMQIAILITTVTLHFKQYEFNSPPNNQVMLCEPTIIERNITEIVYLTNTTIEKEICPKLAEYRSWSKPQCDITGFAPFSKDNSIRLSAGGDIWVTREPYVSCDPDRCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 20689 - protein, 469 aa, Artificial Sequence; identical to SEQ ID NO: 20687
  neuraminidase__InfluenzaA__AEG65585

SEQ ID NO: 20690 - protein, 469 aa, Artificial Sequence; identical to SEQ ID NO: 20687
  neuraminidase__InfluenzaA__AEG65596

SEQ ID NO: 20691 - protein, 469 aa, Artificial Sequence
  neuraminidase__InfluenzaA__AEG65607
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIASSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 20692 - protein, 469 aa, Artificial Sequence
  neuraminidase__InfluenzaA__AEG65629
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNDEEGGHGVKGWAFDDGNDVWMGRTISEKLRSGYETFKVIEGWSNPNSKLQINRQVIVDRGNRSGYSGIFSVEGKSCINRCFYVELIRGRKEEIEVLWTSNSIVVFCGTSGTYGTGSWPDGADINLMPI

SEQ ID NO: 20693 - protein, 469 aa, Artificial Sequence; identical to SEQ ID NO: 20692
  neuraminidase__InfluenzaA__AEG65640

SEQ ID NO: 20694 - protein, 469 aa, Artificial Sequence; identical to SEQ ID NO: 14135
  neuraminidase__InfluenzaA__AEG65651

SEQ ID NO: 20695 - protein, 469 aa, Artificial Sequence; identical to SEQ ID NO: 14714
  neuraminidase__InfluenzaA__AEG65662

SEQ ID NO: 20696 - protein, 469 aa, Artificial Sequence; identical to SEQ ID NO: 14714
  neuraminidase__InfluenzaA__AEG65673

SEQ ID NO: 20697 - protein, 469 aa, Artificial Sequence; identical to SEQ ID NO: 14714
  neuraminidase__InfluenzaA__AEG65684

SEQ ID NO: 20698 - protein, 469 aa, Artificial Sequence; identical to SEQ ID NO: 20671
  neuraminidase__InfluenzaA__AEG65695

SEQ ID NO: 20699 - protein, 469 aa, Artificial Sequence
  neuraminidase__InfluenzaA__AEG65706
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEENEVLWTSNSIVVFCGTSGTYGTGSWPDGADINLMPI

SEQ ID NO: 20700 - protein, 469 aa, Artificial Sequence
  neuraminidase__InfluenzaA__AEG65728
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGAEINLMPI

SEQ ID NO: 20701 - protein, 469 aa, Artificial Sequence
  neuraminidase__InfluenzaA__AEG65739
MNPNQKIITIGSVSLTISTICFFMQIAILITTVTLHFKQYEFSSPPNNQVMPCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINMKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 20702 - protein, 469 aa, Artificial Sequence; identical to SEQ ID NO: 16564
  neuraminidase__InfluenzaA__AEG65750

SEQ ID NO: 20703 - protein, 469 aa, Artificial Sequence; identical to SEQ ID NO: 20700
  neuraminidase__InfluenzaA__AEG65761

SEQ ID NO: 20704 - protein, 469 aa, Artificial Sequence
  neuraminidase__InfluenzaA__AEG65772
MNPNQKIITIGSVSLTISTICFFMQTAILITTVTLHFKQYEFNSPPNNQVMLCEPTIIERNITEIVYLTNTTIEKEMCPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIIHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKEETEVLWTSNSIVVFCGTSGTYGTGSWPDGADINLMPI

SEQ ID NO: 20705 - protein, 469 aa, Artificial Sequence; identical to SEQ ID NO: 19518
  neuraminidase__InfluenzaA__AEG65783

SEQ ID NO: 20706 - protein, 469 aa, Artificial Sequence
  neuraminidase__InfluenzaA__AEG65794
MNPNQKIITIGSVSLTISTICFFMQIAILITTITLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 20707 - protein, 469 aa, Artificial Sequence; identical to SEQ ID NO: 19518
  neuraminidase__InfluenzaA__AEG65805

SEQ ID NO: 20708 - protein, 469 aa, Artificial Sequence
  neuraminidase__InfluenzaA__AEG65816
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20709 - protein, 469 aa, Artificial Sequence
  neuraminidase__InfluenzaA__AEG79808
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20710 - protein, 469 aa, Artificial Sequence; identical to SEQ ID NO: 20709
  neuraminidase__InfluenzaA__AEG79814

SEQ ID NO: 20711 - protein, 469 aa, Artificial Sequence
  neuraminidase__InfluenzaA__AEG79826
MNPNQKIITISSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTMGWSWPDGAELPFTIDK

SEQ ID NO: 20712 - protein, 469 aa, Artificial Sequence
  neuraminidase__InfluenzaA__AEG79830
MNPNQKIITISSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20713 - protein, 469 aa, Artificial Sequence; identical to SEQ ID NO: 20257
  neuraminidase__InfluenzaA__AEG79836

SEQ ID NO: 20714 - protein, 469 aa, Artificial Sequence
  neuraminidase__InfluenzaA__AEH59356
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGTLLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTVWTSGSSISFCGVNSDTVGWSWPDGAELPFTIDK

SEQ ID NO: 20715 - protein, 469 aa, Artificial Sequence; identical to SEQ ID NO: 20709
  neuraminidase__InfluenzaA__AEH59360

SEQ ID NO: 20716 - protein, 469 aa, Artificial Sequence
  neuraminidase__InfluenzaA__AEH59364
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPNDGQASYKIFRIEKGKIVKSVEMNAPNYHYEECSCYPDSSEITCVCRDNWHGANRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20717 - protein, 469 aa, Artificial Sequence
  neuraminidase__InfluenzaA__AEH59366
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGGVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20718 - protein, 469 aa, Artificial Sequence; identical to SEQ ID NO: 20709
  neuraminidase__InfluenzaA__AEH59368

SEQ ID NO: 20719 - protein, 469 aa, Artificial Sequence; identical to SEQ ID NO: 20257
  neuraminidase__InfluenzaA__AEH59370

SEQ ID NO: 20720 - protein, 469 aa, Artificial Sequence; identical to SEQ ID NO: 20716
  neuraminidase__InfluenzaA__AEH59372

SEQ ID NO: 20721 - protein, 469 aa, Artificial Sequence; identical to SEQ ID NO: 20716
  neuraminidase__InfluenzaA__AEH59376

SEQ ID NO: 20722 - protein, 469 aa, Artificial Sequence; identical to SEQ ID NO: 20257
  neuraminidase__InfluenzaA__AEH59378

SEQ ID NO: 20723 - protein, 469 aa, Artificial Sequence; identical to SEQ ID NO: 20716
  neuraminidase__InfluenzaA__AEH59382

SEQ ID NO: 20724 - protein, 469 aa, Artificial Sequence
  neuraminidase__InfluenzaA__AEH59384
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGRIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20725 - protein, 469 aa, Artificial Sequence
  neuraminidase__InfluenzaA__AEH59386
MNPNQKIITIGSVCMTIGMANLILQIGNIISIWISHSIQIGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20726 - protein, 469 aa, Artificial Sequence; identical to SEQ ID NO: 20716
  neuraminidase__InfluenzaA__AEH59388

SEQ ID NO: 20727 - protein, 469 aa, Artificial Sequence
  neuraminidase__InfluenzaA__AEH59390
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGLNEWSGYSGSFVQHPELTGLDCIRPCFWVELIRGLPKENTIWTSGSSISFCGVNSDTVGWSWPDGAELPFTIDK

SEQ ID NO: 20728 - protein, 469 aa, Artificial Sequence; identical to SEQ ID NO: 20716
  neuraminidase__InfluenzaA__AEH59392

SEQ ID NO: 20729 - protein, 469 aa, Artificial Sequence; identical to SEQ ID NO: 20716
  neuraminidase__InfluenzaA__AEH59396

SEQ ID NO: 20730 - protein, 469 aa, Artificial Sequence
  neuraminidase__InfluenzaA__AEH59398
MNPNQKIITIGSVCMTIGVANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNYILRTQESECACVNGSCFTIMTDGPSDGQASYKIFRIEKGKVVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 20731 - protein, 469 aa, Artificial Sequence
  neuraminidase__InfluenzaA__AEH59400
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPNDGQASYKIFRIEKGKIVKSVEMNAPNYHYEECSCYPDSSEITCVCRDNWHGANRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20732 - protein, 469 aa, Artificial Sequence
  neuraminidase__InfluenzaA__AEH59402
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPNDGQASYKIFRIEKGKIVKSVEMNAPNYHYEECSCYPDSSEITCVCRDNWHGANRPWVSFNQNLEYQIGYICSGIFGDNPRPNDKTGSCGPVSSNGANGVKGFSFKYGNGVWIGRTKSISSRNGFEMIWDPNGWTETDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20733 - protein, 469 aa, Artificial Sequence
  neuraminidase__InfluenzaA__AEH59404
MNPNQKIITIGSACMTIGMANLILQIGNIISIWISHSIQLGNQSQIETCNQSVITYENNTWVNQTYVNISNTNFAAGQPVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20734 - protein, 469 aa, Artificial Sequence
  neuraminidase__InfluenzaA__AEH59406
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPTYHYEECSCYPDSSEITCVCRDNWHGSNRPWVSFNQNLEYQIGYICSGIFGDNPRPNDKTGSCGPVSFNGANGVKGFSFKYGNGVWIGRTKSISSRKGFEMIWDPNGWTGTDNNFSIKQDIVGIDEWSGYSGSFVQHPELTGLDCIRPCFWVELIRGRPKENTIWTSGSSISFCGVNSDTVGWSWPDGAELPFTIDK

SEQ ID NO: 20735 - protein, 469 aa, Artificial Sequence; identical to SEQ ID NO: 20257
  neuraminidase__InfluenzaA__AEH59408

SEQ ID NO: 20736 - protein, 469 aa, Artificial Sequence
  neuraminidase__InfluenzaA__AEH59412
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIRSWRNNILRTQESECACVNGSCFTIMTDGPSDGQASYKIFRIEKGKIIKSVEMNAPNYHYEECSCYPDSSEITCVCRDNWHGSNRPWVSFNQNLEYQIGYICSGIFGDNPRPNDKTGSCGPVLSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20737 - protein, 469 aa, Artificial Sequence; identical to SEQ ID NO: 20709
  neuraminidase__InfluenzaA__AEH59416

SEQ ID NO: 20738 - protein, 469 aa, Artificial Sequence; identical to SEQ ID NO: 16738
  neuraminidase__InfluenzaA__AEH59584

SEQ ID NO: 20739 - protein, 469 aa, Artificial Sequence; identical to SEQ ID NO: 16738
  neuraminidase__InfluenzaA__AEH59586

SEQ ID NO: 20740 - protein, 469 aa, Artificial Sequence; identical to SEQ ID NO: 16738
  neuraminidase__InfluenzaA__AEH59588

SEQ ID NO: 20741 - protein, 469 aa, Artificial Sequence; identical to SEQ ID NO: 16738
  neuraminidase__InfluenzaA__AEH59592

SEQ ID NO: 20742 - protein, 469 aa, Artificial Sequence; identical to SEQ ID NO: 16738
  neuraminidase__InfluenzaA__AEH59594

SEQ ID NO: 20743 - protein, 469 aa, Artificial Sequence; identical to SEQ ID NO: 16738
  neuraminidase__InfluenzaA__AEH59596

SEQ ID NO: 20744 - protein, 469 aa, Artificial Sequence; identical to SEQ ID NO: 16738
  neuraminidase__InfluenzaA__AEH59598

SEQ ID NO: 20745 - protein, 469 aa, Artificial Sequence; identical to SEQ ID NO: 16738
  neuraminidase__InfluenzaA__AEH59600

SEQ ID NO: 20746 - protein, 469 aa, Artificial Sequence
  neuraminidase__InfluenzaA__AEH59602
MNPNQKIITIGSVCMTIGMANLILQIGNIISIWISHSIQLGSQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20747 - protein, 469 aa, Artificial Sequence; identical to SEQ ID NO: 16738
  neuraminidase__InfluenzaA__AEH59606

SEQ ID NO: 20748 - protein, 469 aa, Artificial Sequence; identical to SEQ ID NO: 16738
  neuraminidase__InfluenzaA__AEH59616

SEQ ID NO: 20749 - protein, 469 aa, Artificial Sequence; identical to SEQ ID NO: 16738
  neuraminidase__InfluenzaA__AEH59626

SEQ ID NO: 20750 - protein, 470 aa, Artificial Sequence; identical to SEQ ID NO: 17461
  neuraminidase__InfluenzaA__AEH77262

SEQ ID NO: 20751 - protein, 469 aa, Artificial Sequence
  neuraminidase__InfluenzaA__AEH77273
MNPNQKIITIGSVCMTIGMANLILQIGNITSIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20752 - protein, 469 aa, Artificial Sequence
  neuraminidase__InfluenzaA__AEH77282
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFVEEGKIVHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 20753 - protein, 469 aa, Artificial Sequence; identical to SEQ ID NO: 16738
  neuraminidase__InfluenzaA__AEI29218

SEQ ID NO: 20754 - protein, 469 aa, Artificial Sequence; identical to SEQ ID NO: 18105
  neuraminidase__InfluenzaA__AEI29228

SEQ ID NO: 20755 - protein, 469 aa, Artificial Sequence; identical to SEQ ID NO: 14137
  neuraminidase__InfluenzaA__AEI54350

SEQ ID NO: 20756 - protein, 469 aa, Artificial Sequence; identical to SEQ ID NO: 14150
  neuraminidase__InfluenzaA__AEI54361

SEQ ID NO: 20757 - protein, 469 aa, Artificial Sequence; identical to SEQ ID NO: 14714
  neuraminidase__InfluenzaA__AEI54372

SEQ ID NO: 20758 - protein, 469 aa, Artificial Sequence; identical to SEQ ID NO: 14591
  neuraminidase__InfluenzaA__AEI54383

SEQ ID NO: 20759 - protein, 469 aa, Artificial Sequence; identical to SEQ ID NO: 14714
  neuraminidase__InfluenzaA__AEI54394

SEQ ID NO: 20760 - protein, 469 aa, Artificial Sequence; identical to SEQ ID NO: 15884
  neuraminidase__InfluenzaA__AEI54416

SEQ ID NO: 20761 - protein, 469 aa, Artificial Sequence; identical to SEQ ID NO: 20704
  neuraminidase__InfluenzaA__AEI54427

SEQ ID NO: 20762 - protein, 469 aa, Artificial Sequence; identical to SEQ ID NO: 19518
  neuraminidase__InfluenzaA__AEI54438

SEQ ID NO: 20763 - protein, 469 aa, Artificial Sequence; identical to SEQ ID NO: 19518
  neuraminidase__InfluenzaA__AEI54449

SEQ ID NO: 20764 - protein, 469 aa, Artificial Sequence; identical to SEQ ID NO: 19518
  neuraminidase__InfluenzaA__AEI54460

SEQ ID NO: 20765 - protein, 469 aa, Artificial Sequence
  neuraminidase__InfluenzaA__AEI54471
MNPNQKIITIGSVSLTISTICFFMQIAVLITTVTLHFKQYKFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20766 - protein, 469 aa, Artificial Sequence; identical to SEQ ID NO: 19410
  neuraminidase__InfluenzaA__AEI54482

SEQ ID NO: 20767 - protein, 469 aa, Artificial Sequence
  neuraminidase__InfluenzaA__AEI54493
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMSI

SEQ ID NO: 20768 - protein, 469 aa, Artificial Sequence; identical to SEQ ID NO: 19518
  neuraminidase__InfluenzaA__AEI54504

SEQ ID NO: 20769 - protein, 469 aa, Artificial Sequence; identical to SEQ ID NO: 19038
  neuraminidase__InfluenzaA__AEI59982

SEQ ID NO: 20770 - protein, 470 aa, Artificial Sequence; identical to SEQ ID NO: 19936
  neuraminidase__InfluenzaA__AEI59993

SEQ ID NO: 20771 - protein, 470 aa, Artificial Sequence; identical to SEQ ID NO: 19932
  neuraminidase__InfluenzaA__AEI60004

SEQ ID NO: 20772 - protein, 469 aa, Artificial Sequence
  neuraminidase__InfluenzaA__AEI60015
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGNGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20773 - protein, 469 aa, Artificial Sequence; identical to SEQ ID NO: 18484
  neuraminidase__InfluenzaA__AEI60026

SEQ ID NO: 20774 - protein, 469 aa, Artificial Sequence
  neuraminidase__InfluenzaA__AEI60037
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRRNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20775 - protein, 469 aa, Artificial Sequence
  neuraminidase__InfluenzaA__AEI60048
MNPNQKIITIGSVSLTISTICFFMQIAILITTVTLHFKQYEFNSPPNNQVMLCAPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20776 - protein, 469 aa, Artificial Sequence
  neuraminidase__InfluenzaA__AEI60089
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20777 - protein, 469 aa, Artificial Sequence; identical to SEQ ID NO: 20709
  neuraminidase__InfluenzaA__AEI60099

SEQ ID NO: 20778 - protein, 469 aa, Artificial Sequence
  neuraminidase__InfluenzaA__AEI60111
MNPNQKIITIGSISLTIATICFLMQIAILVTTVTLHFKQYKCNSPPNNRVMLCEPTIIERNITEIVYLTNTTIEKEICPKLAEYRNWSKPQCNIKGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCITGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVRDYSIVSSYVCSGLVGDTPRKNDSFSSSHCLDPNNEEGGHGVKGWAFDDGNDVWMGRTISEKLRSGYETFKVIEGWSKPNSKLQVNRQVIVERGNRSGYSGIFSVEGKSCINRCFYVELIRGRKEETKVWWTSNSIVVFCGTSGTYGTGSWPDGADINIMPI

SEQ ID NO: 20779 - protein, 469 aa, Artificial Sequence; identical to SEQ ID NO: 16738
  neuraminidase__InfluenzaA__AEI73669

SEQ ID NO: 20780 - protein, 469 aa, Artificial Sequence
  neuraminidase__InfluenzaA__AEI86727
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSKFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20781 - protein, 469 aa, Artificial Sequence
  neuraminidase__InfluenzaA__AEI86737
MNPNQKIITIGSVCMTIGMANLILQIGNIISIWISHSIQLGNQNQIETCNQSVITYENKTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKVVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20782 - protein, 469 aa, Artificial Sequence
  neuraminidase__InfluenzaA__AEI86757
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSIISRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20783 - protein, 469 aa, Artificial Sequence
  neuraminidase__InfluenzaA__AEI86767
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNHNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20784 - protein, 469 aa, Artificial Sequence; identical to SEQ ID NO: 20783
  neuraminidase__InfluenzaA__AEI86777

SEQ ID NO: 20785 - protein, 469 aa, Artificial Sequence
  neuraminidase__InfluenzaA__AEI86787
MNPNQKIITIGSVCMTIGMANLMLQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20786 - protein, 469 aa, Artificial Sequence
  neuraminidase__InfluenzaA__AEI86797
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20787 - protein, 469 aa, Artificial Sequence
  neuraminidase__InfluenzaA__AEI86807
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSKITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFIIDK

SEQ ID NO: 20788 - protein, 469 aa, Artificial Sequence; identical to SEQ ID NO: 20783
  neuraminidase__InfluenzaA__AEI86817

SEQ ID NO: 20789 - protein, 469 aa, Artificial Sequence
  neuraminidase__InfluenzaA__AEI86827
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNHNLEYQIGYICSGIFGDNPRPNDKTGSCGPVSSNGANGVKGFSFKYGNGVWIGRTKSTSSRNGFEMIWDPNGWTGTDNNFSIKQDIVGINEWSGYSGSFVQHPELTGLNCIRPCFWVELIRGRPKENTIWTSGSSISFCGVNSDTVGWSWPDGAELPFTIDK

SEQ ID NO: 20790 - protein, 469 aa, Artificial Sequence; identical to SEQ ID NO: 20786
  neuraminidase__InfluenzaA__AEI86837

SEQ ID NO: 20791 - protein, 469 aa, Artificial Sequence; identical to SEQ ID NO: 20257
  neuraminidase__InfluenzaA__AEI86847

SEQ ID NO: 20792 - protein, 469 aa, Artificial Sequence
  neuraminidase__InfluenzaA__AEI86867
MNPNQKIITIGSVCMTIGMANLILQIGNIISIWISHSIQLGNQNQIETCNQSVITYENNTWVNQTYVNISNTNLAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSKFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20793 - protein, 469 aa, Artificial Sequence; identical to SEQ ID NO: 20786
  neuraminidase__InfluenzaA__AEI86887

SEQ ID NO: 20794 - protein, 469 aa, Artificial Sequence; identical to SEQ ID NO: 20786
  neuraminidase__InfluenzaA__AEI86897

SEQ ID NO: 20795 - protein, 469 aa, Artificial Sequence
  neuraminidase__InfluenzaA__AEI86907
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDIHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20796 - protein, 469 aa, Artificial Sequence
  neuraminidase__InfluenzaA__AEI86917
MNPNQKIITIGSICMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20797 - protein, 469 aa, Artificial Sequence; identical to SEQ ID NO: 20709
  neuraminidase__InfluenzaA__AEI86927

SEQ ID NO: 20798 - protein, 469 aa, Artificial Sequence; identical to SEQ ID NO: 20783
  neuraminidase__InfluenzaA__AEI86937

SEQ ID NO: 20799 - protein, 469 aa, Artificial Sequence
  neuraminidase__InfluenzaA__AEI86947
MNPNQKIITIGSVCMTIGMANLILQIGNIISIWISHSIQLGNKNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGIKEWSGYSGSFVQHPELTGLDCIRPCFWVELIRGRPKENTIWTSGSSISFCGVNSDTVGWSWPDGAELPFTIDK

SEQ ID NO: 20800 - protein, 469 aa, Artificial Sequence
  neuraminidase__InfluenzaA__AEI86967
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDAFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20801 - protein, 469 aa, Artificial Sequence
  neuraminidase__InfluenzaA__AEI86977
MNPNQKIITIGSVCMTIGMANLILQIGNIISIWISHSIQLGNQNQIGTCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECTCVNGSCFTVMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20802 - protein, 469 aa, Artificial Sequence
  neuraminidase__InfluenzaA__AEI86997
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGIKEWSGYSGSFVQHPELTGLDCIRPCFWVELIRGRPKENTIWTSGSIISFCGVNSDTVGWSWPDGAELPFTIDK

SEQ ID NO: 20803 - protein, 469 aa, Artificial Sequence
  neuraminidase__InfluenzaA__AEI87007
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSSLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20804 - protein, 469 aa, Artificial Sequence
  neuraminidase__InfluenzaA__AEI87017
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNGDTGGWSWPDGAELPFTIDK

SEQ ID NO: 20805 - protein, 469 aa, Artificial Sequence; identical to SEQ ID NO: 20709
  neuraminidase__InfluenzaA__AEI87027

SEQ ID NO: 20806 - protein, 469 aa, Artificial Sequence; identical to SEQ ID NO: 20802
  neuraminidase__InfluenzaA__AEI87037

SEQ ID NO: 20807 - protein, 469 aa, Artificial Sequence; identical to SEQ ID NO: 20786
  neuraminidase__InfluenzaA__AEI87047

SEQ ID NO: 20808 - protein, 469 aa, Artificial Sequence
  neuraminidase__InfluenzaA__AEI87057
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGIKEWSGYSGSFVQHPELTGLDCIRPCFWVELIRGRPKENTIWTSGSSISFCGVNSDTVGWSWPDGAELPFTIDK

SEQ ID NO: 20809 - protein, 469 aa, Artificial Sequence; identical to SEQ ID NO: 20257
  neuraminidase__InfluenzaA__AEI87067

SEQ ID NO: 20810 - protein, 469 aa, Artificial Sequence
  neuraminidase__InfluenzaA__AEI87077
MNPNQKIITIGSICMTIGMANLILQIGNIISIWISHSIQFGNQNQIGTCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20811 - protein, 469 aa, Artificial Sequence
  neuraminidase__InfluenzaA__AEI87087
MNPNQKIITIGSVCMTIGMANLILQIGNIISIWISHSIQLGNQNQIETCNQSVITYENNTWVNQTYVNISNTNFAAGQSVVSVKLAGNSSLCPISGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGIKEWSGYSGSFVQHPELTGLDCIRPCFWVELIRGRPKENTIWTSGSIISFCSVNSDTVGWSWPDGAELPFTIDK

SEQ ID NO: 20812 - protein, 469 aa, Artificial Sequence; identical to SEQ ID NO: 20783
  neuraminidase__InfluenzaA__AEI87097

SEQ ID NO: 20813 - protein, 469 aa, Artificial Sequence; identical to SEQ ID NO: 20783
  neuraminidase__InfluenzaA__AEI87107

SEQ ID NO: 20814 - protein, 470 aa, Artificial Sequence
  neuraminidase__InfluenzaA__AEI91968
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIKPCFWVELVRGLPRENTTIWTSGSSISFCGVNSDTANWSWPDGAELPFTIDK

SEQ ID NO: 20815 - protein, 469 aa, Artificial Sequence; identical to SEQ ID NO: 16738
  neuraminidase__InfluenzaA__AEI91983

SEQ ID NO: 20816 - protein, 469 aa, Artificial Sequence; identical to SEQ ID NO: 19224
  neuraminidase__InfluenzaA__AEI91984

SEQ ID NO: 20817 - protein, 469 aa, Artificial Sequence
  neuraminidase__InfluenzaA__AEI92004
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGAYGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20818 - protein, 470 aa, Artificial Sequence
  neuraminidase__InfluenzaA__AEI92023
MNPNQKIITIGSISIAIGIISLMLQIGNIISIWASHSIQTGSQNNTGICNQKIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGTNGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20819 - protein, 469 aa, Artificial Sequence
  neuraminidase__InfluenzaA__AEJ10403
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSANGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20820 - protein, 469 aa, Artificial Sequence; identical to SEQ ID NO: 20786
  neuraminidase__InfluenzaA__AEJ10413

SEQ ID NO: 20821 - protein, 469 aa, Artificial Sequence; identical to SEQ ID NO: 20808
  neuraminidase__InfluenzaA__AEJ10423

SEQ ID NO: 20822 - protein, 469 aa, Artificial Sequence
  neuraminidase__InfluenzaA__AEJ10433
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKENTIWTSGSSISFCGVNSGTVGWSWPDGAELPFTIDK

SEQ ID NO: 20823 - protein, 469 aa, Artificial Sequence; identical to SEQ ID NO: 20257
  neuraminidase__InfluenzaA__AEJ10443

SEQ ID NO: 20824 - protein, 469 aa, Artificial Sequence; identical to SEQ ID NO: 20257
  neuraminidase__InfluenzaA__AEJ10453

SEQ ID NO: 20825 - protein, 469 aa, Artificial Sequence; identical to SEQ ID NO: 20709
  neuraminidase__InfluenzaA__AEJ10463

SEQ ID NO: 20826 - protein, 469 aa, Artificial Sequence
  neuraminidase__InfluenzaA__AEJ10473
MNPNQKIITIGSVCMTIGMANLILQIGNIISIWISHSIQLGNQNQIETCNQSVITYENKTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLNCIRPCFWVELIRGRPKENTIWTSGSSISFCGVNSDTVGWSWPDGAELPFTIDK

SEQ ID NO: 20827 - protein, 469 aa, Artificial Sequence; identical to SEQ ID NO: 20257
  neuraminidase__InfluenzaA__AEJ10503

SEQ ID NO: 20828 - protein, 469 aa, Artificial Sequence; identical to SEQ ID NO: 16738
  neuraminidase__InfluenzaA__AEJ10523

SEQ ID NO: 20829 - protein, 469 aa, Artificial Sequence; identical to SEQ ID NO: 16738
  neuraminidase__InfluenzaA__AEJ10533

SEQ ID NO: 20830 - protein, 469 aa, Artificial Sequence; identical to SEQ ID NO: 16738
  neuraminidase__InfluenzaA__AEJ10543

SEQ ID NO: 20831 - protein, 469 aa, Artificial Sequence; identical to SEQ ID NO: 16738
  neuraminidase__InfluenzaA__AEJ10553

SEQ ID NO: 20832 - protein, 469 aa, Artificial Sequence; identical to SEQ ID NO: 19013
  neuraminidase__InfluenzaA__AEJ10563

SEQ ID NO: 20833 - protein, 469 aa, Artificial Sequence; identical to SEQ ID NO: 19013
  neuraminidase__InfluenzaA__AEJ10573

SEQ ID NO: 20834 - protein, 469 aa, Artificial Sequence; identical to SEQ ID NO: 19013
  neuraminidase__InfluenzaA__AEJ10583

SEQ ID NO: 20835 - protein, 469 aa, Artificial Sequence
  neuraminidase__InfluenzaA__AEJ36305
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSTSSRNGFEMIWDPNGWTGTDNSFSIKQDIVGINEWSGYSGSFVQHPELTGLDCIRPCFWVELIRGRPKENTIWTSGSSISFCGVNSDTVGWSWPDGAELPFTIDK

SEQ ID NO: 20836 - protein, 469 aa, Artificial Sequence; identical to SEQ ID NO: 16738
  neuraminidase__InfluenzaA__AEJ37856

SEQ ID NO: 20837 - protein, 469 aa, Artificial Sequence; identical to SEQ ID NO: 16738
  neuraminidase__InfluenzaA__AEJ37866

SEQ ID NO: 20838 - protein, 469 aa, Artificial Sequence; identical to SEQ ID NO: 16738
  neuraminidase__InfluenzaA__AEJ37876

SEQ ID NO: 20839 - protein, 469 aa, Artificial Sequence; identical to SEQ ID NO: 20786
  neuraminidase__InfluenzaA__AEJ37886

SEQ ID NO: 20840 - protein, 469 aa, Artificial Sequence
  neuraminidase__InfluenzaA__AEJ37896
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGRIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20841 - protein, 469 aa, Artificial Sequence; identical to SEQ ID NO: 20786
  neuraminidase__InfluenzaA__AEJ37906

SEQ ID NO: 20842 - protein, 469 aa, Artificial Sequence; identical to SEQ ID NO: 20786
  neuraminidase__InfluenzaA__AEJ37916

SEQ ID NO: 20843 - protein, 469 aa, Artificial Sequence; identical to SEQ ID NO: 20786
  neuraminidase__InfluenzaA__AEJ37926

SEQ ID NO: 20844 - protein, 469 aa, Artificial Sequence; identical to SEQ ID NO: 18640
  neuraminidase__InfluenzaA__AEJ37936

SEQ ID NO: 20845 - protein, 469 aa, Artificial Sequence; identical to SEQ ID NO: 16738
  neuraminidase__InfluenzaA__AEJ37946

SEQ ID NO: 20846 - protein, 469 aa, Artificial Sequence; identical to SEQ ID NO: 20786
  neuraminidase__InfluenzaA__AEJ37956

SEQ ID NO: 20847 - protein, 469 aa, Artificial Sequence; identical to SEQ ID NO: 20786
  neuraminidase__InfluenzaA__AEJ37966

SEQ ID NO: 20848 - protein, 469 aa, Artificial Sequence; identical to SEQ ID NO: 16738
  neuraminidase__InfluenzaA__AEJ37976

SEQ ID NO: 20849 - protein, 469 aa, Artificial Sequence; identical to SEQ ID NO: 20786
  neuraminidase__InfluenzaA__AEJ37986

SEQ ID NO: 20850 - protein, 469 aa, Artificial Sequence; identical to SEQ ID NO: 19410
  neuraminidase__InfluenzaA__AEK21372

SEQ ID NO: 20851 - protein, 470 aa, Artificial Sequence; identical to SEQ ID NO: 20204
  neuraminidase__InfluenzaA__AEK21383

SEQ ID NO: 20852 - protein, 469 aa, Artificial Sequence; identical to SEQ ID NO: 18640
  neuraminidase__InfluenzaA__AEK21399

SEQ ID NO: 20853 - protein, 469 aa, Artificial Sequence; identical to SEQ ID NO: 16738
  neuraminidase__InfluenzaA__AEK21409

SEQ ID NO: 20854 - protein, 469 aa, Artificial Sequence; identical to SEQ ID NO: 20709
  neuraminidase__InfluenzaA__AEK21419

SEQ ID NO: 20855 - protein, 469 aa, Artificial Sequence; identical to SEQ ID NO: 20786
  neuraminidase__InfluenzaA__AEK21429

SEQ ID NO: 20856 - protein, 469 aa, Artificial Sequence
  neuraminidase__InfluenzaA__AEK21439
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSKKQDIVGINEWSGYSGSFVQHPELTGLDCIRPCFWVELIRGRPKENTIWTSGSSISFCGVNSDTVGWSWPDGAELPFTIDK

SEQ ID NO: 20857 - protein, 469 aa, Artificial Sequence; identical to SEQ ID NO: 20786
  neuraminidase__InfluenzaA__AEK21449

SEQ ID NO: 20858 - protein, 469 aa, Artificial Sequence; identical to SEQ ID NO: 18640
  neuraminidase__InfluenzaA__AEK21459

SEQ ID NO: 20859 - protein, 469 aa, Artificial Sequence; identical to SEQ ID NO: 20786
  neuraminidase__InfluenzaA__AEK21469

SEQ ID NO: 20860 - protein, 469 aa, Artificial Sequence; identical to SEQ ID NO: 20786
  neuraminidase__InfluenzaA__AEK21479

SEQ ID NO: 20861 - protein, 469 aa, Artificial Sequence; identical to SEQ ID NO: 16738
  neuraminidase__InfluenzaA__AEK21489

SEQ ID NO: 20862 - protein, 469 aa, Artificial Sequence; identical to SEQ ID NO: 20454
  neuraminidase__InfluenzaA__AEK28776

SEQ ID NO: 20863 - protein, 469 aa, Artificial Sequence
  neuraminidase__InfluenzaA__AEK28787
MNPNQKIITIGSVSLTISTICFFMQIAILITTVTLHFKQYEFYSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGRSCINRCFYVELIRGRKEETEVLWTSNSIVVFCGTSGTYGTGSWPDGADLNLMPI

SEQ ID NO: 20864 - protein, 469 aa, Artificial Sequence
  neuraminidase__InfluenzaA__AEK28798
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGNASGKADTKILFIEEGKIVHTSTLSGSAQHVEECSCYPRYPGVRCVCRDNWKGSNRPIVDINIKDHSIVSSYVCSGLVGDTPRKNDSSSSSHCSDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20865 - protein, 469 aa, Artificial Sequence
  neuraminidase__InfluenzaA__AEK28809
MNPNQKIITIGSVSLTISTICFFMQIAILITTVTVHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNKVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20866 - protein, 469 aa, Artificial Sequence
  neuraminidase__InfluenzaA__AEK28819
MNPNQKIITIGSVSLTISTICFFMQIAILITTVTLHFKQYEFNYPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRERTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20867 - protein, 469 aa, Artificial Sequence
  neuraminidase__InfluenzaA__AEK28830
MNPNQKIITIGSVSLTISTICFFMQIAILITTVTLHFKQYEFNSPPNNQVMLCEPTIIERNITEIVYLTNTTIEKEICPNLAEYRNWSKPQCDITGFAPFSKDNSIRLSAGGDIWVTREPYVSCDPDKCYQFALGQGTTLNNVHSNNTVRGRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20868 - protein, 469 aa, Artificial Sequence
  neuraminidase__InfluenzaA__AEK28841
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTVNNVHSNNTVRGRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20869 - protein, 469 aa, Artificial Sequence
  neuraminidase__InfluenzaA__AEK28852
MNPNQKIITIGSVSLTISTICFFMQIAILITTVTLHFKQYEFNSPPNNQVMLCEPTIIEKNITEIVYLTNTTIEKEICPKLAEYRNWSKPQCDITGFAPFSKDNSIRLSAGGDIWVTREPYVSCDPDKCYQFALGQGTTLNNVHSNNRVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20870 - protein, 469 aa, Artificial Sequence; identical to SEQ ID NO: 18484
  neuraminidase__InfluenzaA__AEK28863

SEQ ID NO: 20871 - protein, 469 aa, Artificial Sequence
  neuraminidase__InfluenzaA__AEK28874
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNKVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20872 - protein, 469 aa, Artificial Sequence
  neuraminidase__InfluenzaA__AEK28885
MNPNQKIITIGSVSLTISTICFFMQIAILITTVTLHFKQYEFNLPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20873 - protein, 469 aa, Artificial Sequence; identical to SEQ ID NO: 18609
  neuraminidase__InfluenzaA__AEK28896

SEQ ID NO: 20874 - protein, 469 aa, Artificial Sequence
  neuraminidase__InfluenzaA__AEK28907
MNPNQKIITIGSVSLTISTICFFMQIAILITTVTLHFKQYEFNSPPNNQVMLCEPTIIEKNITEIVYLTNTTIEKEICPRLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20875 - protein, 469 aa, Artificial Sequence; identical to SEQ ID NO: 16599
  neuraminidase__InfluenzaA__AEK28918

SEQ ID NO: 20876 - protein, 469 aa, Artificial Sequence; identical to SEQ ID NO: 17905
  neuraminidase__InfluenzaA__AEK28929

SEQ ID NO: 20877 - protein, 469 aa, Artificial Sequence
  neuraminidase__InfluenzaA__AEK28951
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRSGYETFKVIEGWSNHKSKLQINRQVIVDRGNRSGYSGIFSVEGKSCINRCFYVELIRGRKEETEALWTSNSIVVFCGTSGTYGTGSWPDGADLNLMPI

SEQ ID NO: 20878 - protein, 469 aa, Artificial Sequence
  neuraminidase__InfluenzaA__AEK28962
MNPNQKIITIGSVSLTISTICFFMQIAILITTVTLHFKQYEFNSPPNNQVMLCEPTIIERNITEIVYPTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20879 - protein, 469 aa, Artificial Sequence
  neuraminidase__InfluenzaA__AEK28973
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNFMPI

SEQ ID NO: 20880 - protein, 469 aa, Artificial Sequence
  neuraminidase__InfluenzaA__AEK28984
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSVRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20881 - protein, 469 aa, Artificial Sequence; identical to SEQ ID NO: 20880
  neuraminidase__InfluenzaA__AEK28995

SEQ ID NO: 20882 - protein, 469 aa, Artificial Sequence; identical to SEQ ID NO: 19518
  neuraminidase__InfluenzaA__AEK29006

SEQ ID NO: 20883 - protein, 469 aa, Artificial Sequence
  neuraminidase__InfluenzaA__AEK29028
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCFDPNDEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20884 - protein, 469 aa, Artificial Sequence
  neuraminidase__InfluenzaA__AEK29050
MNPNQKIITIGSVSLTISTICFFMQIAILITTVTLHFKQYEFNPPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20885 - protein, 469 aa, Artificial Sequence
  neuraminidase__InfluenzaA__AEK29061
MNPNQKIITIGSVSLTISTICFFIQIAILITTVTLHFKQYEFNSPPNNQVMLCEPTIIEKNITEIVYLTNTTIEKEICPKLAEYRNWSKPQCDITGFAPFSKDNSIRLSAGGDIWVTREPYVSCDPDKCYQFALGQGTTLNNVHSNNIVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20886 - protein, 469 aa, Artificial Sequence
  neuraminidase__InfluenzaA__AEK29083
MNPNQKIITIGSVSLTISTICFFIQIAILITTVTLHFKQYEFNSPPNNQVMLCEPTIIEKNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20887 - protein, 469 aa, Artificial Sequence; identical to SEQ ID NO: 19410
  neuraminidase__InfluenzaA__AEK29094

SEQ ID NO: 20888 - protein, 469 aa, Artificial Sequence; identical to SEQ ID NO: 19518
  neuraminidase__InfluenzaA__AEK29127

SEQ ID NO: 20889 - protein, 469 aa, Artificial Sequence; identical to SEQ ID NO: 19518
  neuraminidase__InfluenzaA__AEK29138

SEQ ID NO: 20890 - protein, 469 aa, Artificial Sequence
  neuraminidase__InfluenzaA__AEK29182
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQVNRQVIVDRGNRSGYSGIFSVEGKSCINRCFYVELIRGRKEETEVLWTSNSIVVFCGTSGTYGTGSWPDGADLNLMPI

SEQ ID NO: 20891 - protein, 469 aa, Artificial Sequence
  neuraminidase__InfluenzaA__AEK29204
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKANTKVLFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20892 - protein, 469 aa, Artificial Sequence
  neuraminidase__InfluenzaA__AEK29215
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRNRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 20893 - protein, 469 aa, Artificial Sequence; identical to SEQ ID NO: 20891
  neuraminidase__InfluenzaA__AEK29237

SEQ ID NO: 20894 - protein, 469 aa, Artificial Sequence; identical to SEQ ID NO: 19518
  neuraminidase__InfluenzaA__AEK29248

SEQ ID NO: 20895 - protein, 469 aa, Artificial Sequence; identical to SEQ ID NO: 19518
  neuraminidase__InfluenzaA__AEK29259

SEQ ID NO: 20896 - protein, 469 aa, Artificial Sequence; identical to SEQ ID NO: 19518
  neuraminidase__InfluenzaA__AEK29270

SEQ ID NO: 20897 - protein, 470 aa, Artificial Sequence
  neuraminidase__InfluenzaA__AEK59839
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGLGWLTIGISGPDNGAVAVLKYNGIITGTIKSWKKQILRTQESECVCMNGSCFTIMTDGPSNGAASYKIFKIEKGKVTKSIELNAPNFHYEECSCYPDTGIVMCVCRDNWHGSNRPWVSFNQNLDYQIGYICSGVFGDNPRPKDGEGSCNPVTVDGADGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 20898 - protein, 469 aa, Artificial Sequence
  neuraminidase__InfluenzaA__AEK98375
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQTNRQVIVDRGNRSGYSGIFSVEGKSCINRCFYVELIRGRKEETEVLWTSNSIVVFCGTSGTYGTGSWPDGADINLMPI

SEQ ID NO: 20899 - protein, 469 aa, Artificial Sequence; identical to SEQ ID NO: 16599
  neuraminidase__InfluenzaA__AEK98377

SEQ ID NO: 20900 - protein, 469 aa, Artificial Sequence; identical to SEQ ID NO: 16041
  neuraminidase__InfluenzaA__AEK98379

SEQ ID NO: 20901 - protein, 469 aa, Artificial Sequence
  neuraminidase__InfluenzaA__AEK98381
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGEAWLHVCITGDDKNATASFIYNGRLVDSIVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 20902 - protein, 469 aa, Artificial Sequence; identical to SEQ ID NO: 16041
  neuraminidase__InfluenzaA__AEK98383

SEQ ID NO: 20903 - protein, 469 aa, Artificial Sequence; identical to SEQ ID NO: 16599
  neuraminidase__InfluenzaA__AEK98385

SEQ ID NO: 20904 - protein, 469 aa, Artificial Sequence
  neuraminidase__InfluenzaA__AEK98387
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLIDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20905 - protein, 469 aa, Artificial Sequence; identical to SEQ ID NO: 16599
  neuraminidase__InfluenzaA__AEK98389

SEQ ID NO: 20906 - protein, 469 aa, Artificial Sequence
  neuraminidase__InfluenzaA__AEK98393
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIASSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 20907 - protein, 469 aa, Artificial Sequence; identical to SEQ ID NO: 19518
  neuraminidase__InfluenzaA__AEK98395

SEQ ID NO: 20908 - protein, 469 aa, Artificial Sequence
  neuraminidase__InfluenzaA__AEK98397
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINFMPI

SEQ ID NO: 20909 - protein, 469 aa, Artificial Sequence; identical to SEQ ID NO: 16599
  neuraminidase__InfluenzaA__AEK98399

SEQ ID NO: 20910 - protein, 469 aa, Artificial Sequence; identical to SEQ ID NO: 16512
  neuraminidase__InfluenzaA__AEK98403

SEQ ID NO: 20911 - protein, 469 aa, Artificial Sequence
  neuraminidase__InfluenzaA__AEK98405
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRDNRSGYSGIFSVEGKSCINRCFYVELIRGRKEETEVLWTSNSIVVFCGTSGTYGTGSWPDGADINLMPI

SEQ ID NO: 20912 - protein, 469 aa, Artificial Sequence
  neuraminidase__InfluenzaA__AEK98407
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRVRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRDNRSGYSGIFSVEGKSCINRCFYVELIRGRKEETEVLWTSNSIVVFCGTSGTYGTGSWPDGADINLMPI

SEQ ID NO: 20913 - protein, 469 aa, Artificial Sequence; identical to SEQ ID NO: 14327
  neuraminidase__InfluenzaA__AEL11690

SEQ ID NO: 20914 - protein, 469 aa, Artificial Sequence; identical to SEQ ID NO: 19013
  neuraminidase__InfluenzaA__AEL89300

SEQ ID NO: 20915 - protein, 469 aa, Artificial Sequence; identical to SEQ ID NO: 19013
  neuraminidase__InfluenzaA__AEL89310

SEQ ID NO: 20916 - protein, 469 aa, Artificial Sequence; identical to SEQ ID NO: 19013
  neuraminidase__InfluenzaA__AEL89320

SEQ ID NO: 20917 - protein, 469 aa, Artificial Sequence; identical to SEQ ID NO: 19013
  neuraminidase__InfluenzaA__AEL89330

SEQ ID NO: 20918 - protein, 469 aa, Artificial Sequence; identical to SEQ ID NO: 19013
  neuraminidase__InfluenzaA__AEL89340

SEQ ID NO: 20919 - protein, 469 aa, Artificial Sequence; identical to SEQ ID NO: 19013
  neuraminidase__InfluenzaA__AEL89350

SEQ ID NO: 20920 - protein, 469 aa, Artificial Sequence; identical to SEQ ID NO: 19013
  neuraminidase__InfluenzaA__AEL89360

SEQ ID NO: 20921 - protein, 469 aa, Artificial Sequence; identical to SEQ ID NO: 19013
  neuraminidase__InfluenzaA__AEL89370

SEQ ID NO: 20922 - protein, 469 aa, Artificial Sequence; identical to SEQ ID NO: 19013
  neuraminidase__InfluenzaA__AEL89394

SEQ ID NO: 20923 - protein, 469 aa, Artificial Sequence; identical to SEQ ID NO: 19013
  neuraminidase__InfluenzaA__AEL89404

SEQ ID NO: 20924 - protein, 469 aa, Artificial Sequence; identical to SEQ ID NO: 19013
  neuraminidase__InfluenzaA__AEL89414

SEQ ID NO: 20925 - protein, 469 aa, Artificial Sequence; identical to SEQ ID NO: 19013
  neuraminidase__InfluenzaA__AEL89424

SEQ ID NO: 20926 - protein, 469 aa, Artificial Sequence; identical to SEQ ID NO: 19013
  neuraminidase__InfluenzaA__AEL89434

SEQ ID NO: 20927 - protein, 469 aa, Artificial Sequence; identical to SEQ ID NO: 19013
  neuraminidase__InfluenzaA__AEL89444

SEQ ID NO: 20928 - protein, 469 aa, Artificial Sequence; identical to SEQ ID NO: 19013
  neuraminidase__InfluenzaA__AEL89454

SEQ ID NO: 20929 - protein, 469 aa, Artificial Sequence; identical to SEQ ID NO: 19013
  neuraminidase__InfluenzaA__AEL89464

SEQ ID NO: 20930 - protein, 469 aa, Artificial Sequence; identical to SEQ ID NO: 19013
  neuraminidase__InfluenzaA__AEL89474

SEQ ID NO: 20931 - protein, 469 aa, Artificial Sequence
  neuraminidase__InfluenzaA__AEL89484
MNPNQKIITIGSVCMTIGMANLMLQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEINAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20932 - protein, 469 aa, Artificial Sequence; identical to SEQ ID NO: 20802
  neuraminidase__InfluenzaA__AEL89494

SEQ ID NO: 20933 - protein, 469 aa, Artificial Sequence; identical to SEQ ID NO: 20808
  neuraminidase__InfluenzaA__AEL89514

SEQ ID NO: 20934 - protein, 469 aa, Artificial Sequence; identical to SEQ ID NO: 20786
  neuraminidase__InfluenzaA__AEL89524

SEQ ID NO: 20935 - protein, 469 aa, Artificial Sequence
  neuraminidase__InfluenzaA__AEL89534
MNPNQKIITIGSVCMTIGMANLILQIGNIISIWISHSIQLGNQNQIGTCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEINAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSKKQDIVGINEWSGYSGSFVQHPELTGLDCIRPCFWVELIRGRPKENTIWTSGSSISFCGVNSDTVGWSWPDGAELPFTIDK

SEQ ID NO: 20936 - protein, 469 aa, Artificial Sequence; identical to SEQ ID NO: 20808
  neuraminidase__InfluenzaA__AEL89544

SEQ ID NO: 20937 - protein, 469 aa, Artificial Sequence; identical to SEQ ID NO: 20808
  neuraminidase__InfluenzaA__AEL89554

SEQ ID NO: 20938 - protein, 469 aa, Artificial Sequence
  neuraminidase__InfluenzaA__AEL89564
MNPNQKIITIGSVCITIGMANLILQIGNIISIWISHSIQLGNQNQIETCNQSVVTYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20939 - protein, 469 aa, Artificial Sequence; identical to SEQ ID NO: 20808
  neuraminidase__InfluenzaA__AEL89574

SEQ ID NO: 20940 - protein, 469 aa, Artificial Sequence; identical to SEQ ID NO: 20808
  neuraminidase__InfluenzaA__AEL89584

SEQ ID NO: 20941 - protein, 469 aa, Artificial Sequence; identical to SEQ ID NO: 17755
  neuraminidase__InfluenzaA__AEL89604

SEQ ID NO: 20942 - protein, 469 aa, Artificial Sequence; identical to SEQ ID NO: 20257
  neuraminidase__InfluenzaA__AEL89624

SEQ ID NO: 20943 - protein, 469 aa, Artificial Sequence
  neuraminidase__InfluenzaA__AEL89634
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSYKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20944 - protein, 469 aa, Artificial Sequence; identical to SEQ ID NO: 19013
  neuraminidase__InfluenzaA__AEL89644

SEQ ID NO: 20945 - protein, 469 aa, Artificial Sequence; identical to SEQ ID NO: 20709
  neuraminidase__InfluenzaA__AEL89654

SEQ ID NO: 20946 - protein, 469 aa, Artificial Sequence; identical to SEQ ID NO: 20257
  neuraminidase__InfluenzaA__AEL89664

SEQ ID NO: 20947 - protein, 469 aa, Artificial Sequence; identical to SEQ ID NO: 20257
  neuraminidase__InfluenzaA__AEL89674

SEQ ID NO: 20948 - protein, 469 aa, Artificial Sequence; identical to SEQ ID NO: 20257
  neuraminidase__InfluenzaA__AEL89694

SEQ ID NO: 20949 - protein, 469 aa, Artificial Sequence
  neuraminidase__InfluenzaA__AEL89704
MNPNQKIITIGSVCMTIGMANLILQIGNIILIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPNDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSVKQDIIGINEWSGYSGSFVQHPELTGLDCIRPCFWVELIRGRPKENTIWTSGSSISFCGVNSDTVGWSWPDGAELPFTIDK

SEQ ID NO: 20950 - protein, 469 aa, Artificial Sequence; identical to SEQ ID NO: 20949
  neuraminidase__InfluenzaA__AEL89714

SEQ ID NO: 20951 - protein, 469 aa, Artificial Sequence; identical to SEQ ID NO: 20257
  neuraminidase__InfluenzaA__AEL89744

SEQ ID NO: 20952 - protein, 469 aa, Artificial Sequence
  neuraminidase__InfluenzaA__AEL89754
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFIIDK

SEQ ID NO: 20953 - protein, 469 aa, Artificial Sequence; identical to SEQ ID NO: 19013
  neuraminidase__InfluenzaA__AEL89774

SEQ ID NO: 20954 - protein, 469 aa, Artificial Sequence
  neuraminidase__InfluenzaA__AEL89784
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISLRNGFEMIWDPNGWTGTDNNFSVKQDIIGINEWSGYSGSFVQHPELTGLDCIRPCFWVELIRGRPKENTIWTSGSSISFCGVNSDTVGWSWPDGAELPFTIDK

SEQ ID NO: 20955 - protein, 469 aa, Artificial Sequence
  neuraminidase__InfluenzaA__AEL89794
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDAVGWSWPDGAELPFTIDK

SEQ ID NO: 20956 - protein, 469 aa, Artificial Sequence; identical to SEQ ID NO: 20709
  neuraminidase__InfluenzaA__AEL89804

SEQ ID NO: 20957 - protein, 469 aa, Artificial Sequence
  neuraminidase__InfluenzaA__AEL89815
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSVKQDIIGINEWSGYSGSFVQHPELTGLDCIRPCFWVELIRGRPKENTIWTSGSSISFCGVNSDTVGWSWPDGAELPFTIDK

SEQ ID NO: 20958 - protein, 469 aa, Artificial Sequence
  neuraminidase__InfluenzaA__AEL89825
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGANRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20959 - protein, 469 aa, Artificial Sequence
  neuraminidase__InfluenzaA__AEL89835
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECVCVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20960 - protein, 469 aa, Artificial Sequence
  neuraminidase__InfluenzaA__AEL89845
MNPNQKIITIGSVCMTIGMANLILQIGNIISIWISHSIQLGNKNQIETCNQSVITYENNTWVNQTYVNISNTNFATGQSVVSVKLAGNSSLCPVSGWAIYSKDNSIRIGSKGDVFVIREPFISCSPLECRTFFLTQGALLNDKHSNGTIKDRSPYRTLMSCPIGEAPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20961 - protein, 469 aa, Artificial Sequence; identical to SEQ ID NO: 20958
  neuraminidase__InfluenzaA__AEL89855

SEQ ID NO: 20962 - protein, 469 aa, Artificial Sequence; identical to SEQ ID NO: 20257
  neuraminidase__InfluenzaA__AEL93581

SEQ ID NO: 20963 - protein, 469 aa, Artificial Sequence
  neuraminidase__InfluenzaA__AEL93591
MNPNQKIITIGSVCMTIGMANLILQIGNIISIWISHSIQLGNQNQIETCNQSVITYENNTWVNQTYVNISNTNFAAGQSVVSVNLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20964 - protein, 469 aa, Artificial Sequence; identical to SEQ ID NO: 20709
  neuraminidase__InfluenzaA__AEL93601

SEQ ID NO: 20965 - protein, 469 aa, Artificial Sequence; identical to SEQ ID NO: 20257
  neuraminidase__InfluenzaA__AEL93611

SEQ ID NO: 20966 - protein, 469 aa, Artificial Sequence; identical to SEQ ID NO: 20257
  neuraminidase__InfluenzaA__AEL93621

SEQ ID NO: 20967 - protein, 469 aa, Artificial Sequence; identical to SEQ ID NO: 20257
  neuraminidase__InfluenzaA__AEL93631

SEQ ID NO: 20968 - protein, 469 aa, Artificial Sequence
  neuraminidase__InfluenzaA__AEL93641
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNHNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGQPKENTIWTSGSSISFCGVNSDTVGWSWPDGAELPFTIDK

SEQ ID NO: 20969 - protein, 469 aa, Artificial Sequence; identical to SEQ ID NO: 20808
  neuraminidase__InfluenzaA__AEL94890

SEQ ID NO: 20970 - protein, 469 aa, Artificial Sequence
  neuraminidase__InfluenzaA__AEL95429
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPHRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20971 - protein, 469 aa, Artificial Sequence
  neuraminidase__InfluenzaA__AEL97634
MNPNQKIITIGSVCMTIGMANLILQIGNIISIWVSHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGVNEWSGYSGSFVQHPELTGLDCIRPCFWVELIRGRPKENTIWTSGSSISFCGVNSDTVGWSWPDGAELPFTIDK

SEQ ID NO: 20972 - protein, 469 aa, Artificial Sequence; identical to SEQ ID NO: 16738
  neuraminidase__InfluenzaA__AEL99667

SEQ ID NO: 20973 - protein, 469 aa, Artificial Sequence; identical to SEQ ID NO: 16738
  neuraminidase__InfluenzaA__AEL99677

SEQ ID NO: 20974 - protein, 469 aa, Artificial Sequence; identical to SEQ ID NO: 15776
  neuraminidase__InfluenzaA__AEM53471

SEQ ID NO: 20975 - protein, 470 aa, Artificial Sequence; identical to SEQ ID NO: 16453
  neuraminidase__InfluenzaA__AEM60040

SEQ ID NO: 20976 - protein, 470 aa, Artificial Sequence; identical to SEQ ID NO: 16043
  neuraminidase__InfluenzaA__AEM60061

SEQ ID NO: 20977 - protein, 469 aa, Artificial Sequence
  neuraminidase__InfluenzaA__AEM60072
MNPNQKIITIGSVSLTIATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGREQETRVWWTSNSIVVFCGTSGTYGTGSWPDGADINLMPI

SEQ ID NO: 20978 - protein, 469 aa, Artificial Sequence; identical to SEQ ID NO: 16738
  neuraminidase__InfluenzaA__AEM62774

SEQ ID NO: 20979 - protein, 469 aa, Artificial Sequence; identical to SEQ ID NO: 16738
  neuraminidase__InfluenzaA__AEM62783

SEQ ID NO: 20980 - protein, 469 aa, Artificial Sequence
  neuraminidase__InfluenzaA__AEM62792
MNPNQKIITIGSVCMTIGMANLILQIGNIISIWISHSIQLGSQNQIETCNQSVITYENNTWVNQTYVNISNTNFAAGQSVISVRLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 20981 - protein, 469 aa, Artificial Sequence; identical to SEQ ID NO: 16738
  neuraminidase__InfluenzaA__AEM62801

SEQ ID NO: 20982 - protein, 469 aa, Artificial Sequence
  neuraminidase__InfluenzaA__AEM62810
MNPNQKIITIGSVCMTIGMGNLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20983 - protein, 469 aa, Artificial Sequence
  neuraminidase__InfluenzaA__AEM62819
MNPNQKIITIGSVCMTIGMANLILQIGNIISIWISHSIQLGNQNQIETCNQSVITYENDTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20984 - protein, 469 aa, Artificial Sequence; identical to SEQ ID NO: 16738
  neuraminidase__InfluenzaA__AEM62828

SEQ ID NO: 20985 - protein, 469 aa, Artificial Sequence; identical to SEQ ID NO: 17321
  neuraminidase__InfluenzaA__AEM62837

SEQ ID NO: 20986 - protein, 469 aa, Artificial Sequence; identical to SEQ ID NO: 16738
  neuraminidase__InfluenzaA__AEM62846

SEQ ID NO: 20987 - protein, 469 aa, Artificial Sequence
  neuraminidase__InfluenzaA__AEM62855
MNPNQKIITIGSVCITIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSGEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20988 - protein, 469 aa, Artificial Sequence
  neuraminidase__InfluenzaA__AEM62864
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGIFGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20989 - protein, 469 aa, Artificial Sequence
  neuraminidase__InfluenzaA__AEM62872
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSFNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20990 - protein, 469 aa, Artificial Sequence; identical to SEQ ID NO: 16738
  neuraminidase__InfluenzaA__AEM92310

SEQ ID NO: 20991 - protein, 469 aa, Artificial Sequence; identical to SEQ ID NO: 18200
  neuraminidase__InfluenzaA__AEM92320

SEQ ID NO: 20992 - protein, 469 aa, Artificial Sequence
  neuraminidase__InfluenzaA__AEM92340
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTRTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20993 - protein, 469 aa, Artificial Sequence; identical to SEQ ID NO: 18200
  neuraminidase__InfluenzaA__AEM92350

SEQ ID NO: 20994 - protein, 469 aa, Artificial Sequence
  neuraminidase__InfluenzaA__AEM92360
MNPNQKIITIGSVCMTIGMANLILQIGNIISIWISHSIQLGNQNQIETCNQSVITYENNTWVNQTYVNISNTNFAAEQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20995 - protein, 469 aa, Artificial Sequence; identical to SEQ ID NO: 20992
  neuraminidase__InfluenzaA__AEM92370

SEQ ID NO: 20996 - protein, 469 aa, Artificial Sequence; identical to SEQ ID NO: 20992
  neuraminidase__InfluenzaA__AEM92380

SEQ ID NO: 20997 - protein, 469 aa, Artificial Sequence
  neuraminidase__InfluenzaA__AEM92399
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGTNWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVLSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 20998 - protein, 469 aa, Artificial Sequence; identical to SEQ ID NO: 20997
  neuraminidase__InfluenzaA__AEM92409

SEQ ID NO: 20999 - protein, 469 aa, Artificial Sequence; identical to SEQ ID NO: 17162
  neuraminidase__InfluenzaA__AEM92419

SEQ ID NO: 21000 - protein, 469 aa, Artificial Sequence
  neuraminidase__InfluenzaA__AEM92430
MNPNQKIMTIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21001 - protein, 469 aa, Artificial Sequence
  neuraminidase__InfluenzaA__AEM92440
MNPNQKIITIGSVCITIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMIAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21002 - protein, 469 aa, Artificial Sequence; identical to SEQ ID NO: 20958
  neuraminidase__InfluenzaA__AEM92450

SEQ ID NO: 21003 - protein, 469 aa, Artificial Sequence; identical to SEQ ID NO: 20958
  neuraminidase__InfluenzaA__AEM92460

SEQ ID NO: 21004 - protein, 469 aa, Artificial Sequence; identical to SEQ ID NO: 20709
  neuraminidase__InfluenzaA__AEM92470

SEQ ID NO: 21005 - protein, 469 aa, Artificial Sequence; identical to SEQ ID NO: 20709
  neuraminidase__InfluenzaA__AEM92480

SEQ ID NO: 21006 - protein, 469 aa, Artificial Sequence
  neuraminidase__InfluenzaA__AEM92490
MNPNQKIITIGSVCMIIGMANLMLQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21007 - protein, 469 aa, Artificial Sequence
  neuraminidase__InfluenzaA__AEM92500
MNPNQKIITIGSVCMIIGMANLMLQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQMGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 21008 - protein, 469 aa, Artificial Sequence
  neuraminidase__InfluenzaA__AEM92520
MNPNQKIITIGSVCMTIGMANLMLQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 21009 - protein, 469 aa, Artificial Sequence; identical to SEQ ID NO: 20709
  neuraminidase__InfluenzaA__AEM92550

SEQ ID NO: 21010 - protein, 469 aa, Artificial Sequence
  neuraminidase__InfluenzaA__AEM92570
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGNVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21011 - protein, 469 aa, Artificial Sequence
  neuraminidase__InfluenzaA__AEM92580
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21012 - protein, 469 aa, Artificial Sequence; identical to SEQ ID NO: 20709
  neuraminidase__InfluenzaA__AEM92590

SEQ ID NO: 21013 - protein, 469 aa, Artificial Sequence; identical to SEQ ID NO: 20709
  neuraminidase__InfluenzaA__AEM92600

SEQ ID NO: 21014 - protein, 469 aa, Artificial Sequence
  neuraminidase__InfluenzaA__AEM92610
MNPNQKIITIGSVCMTIGMANLMLQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVSWSWPDGAELPFTIDK

SEQ ID NO: 21015 - protein, 469 aa, Artificial Sequence
  neuraminidase__InfluenzaA__AEM92620
MNPNQKIITIGSVCMIIGMANLMLQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLDDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQMGYICSGIFGDNPRPNDKTGSCGPVSSNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 21016 - protein, 469 aa, Artificial Sequence
  neuraminidase__InfluenzaA__AEM92650
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDTKFSIKQDIVGINEWSGYSGSFVQHPELTGLDCIRPCFWVELIRGRPKENTIWTSGSSISFCGVNSDTVGWSWPDGAELPFTIDK

SEQ ID NO: 21017 - protein, 469 aa, Artificial Sequence; identical to SEQ ID NO: 19410
  neuraminidase__InfluenzaA__AEM98410

SEQ ID NO: 21018 - protein, 469 aa, Artificial Sequence; identical to SEQ ID NO: 19410
  neuraminidase__InfluenzaA__AEM98421

SEQ ID NO: 21019 - protein, 469 aa, Artificial Sequence; identical to SEQ ID NO: 19410
  neuraminidase__InfluenzaA__AEM98432

SEQ ID NO: 21020 - protein, 469 aa, Artificial Sequence; identical to SEQ ID NO: 20786
  neuraminidase__InfluenzaA__AEN55401

SEQ ID NO: 21021 - protein, 469 aa, Artificial Sequence; identical to SEQ ID NO: 19013
  neuraminidase__InfluenzaA__AEN55411

SEQ ID NO: 21022 - protein, 469 aa, Artificial Sequence
  neuraminidase__InfluenzaA__AEN55421
MNPNQKIITIGSVCMTIGMANLILQIGNIISIWISHSIQLGNQSQIETCNQSVITYENNTWVNQTYVNISNTNFAARQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECVCVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21023 - protein, 469 aa, Artificial Sequence
  neuraminidase__InfluenzaA__AEN55466
MNPNQKIITIGSVCITIGMANLILQIGNTISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGISWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21024 - protein, 469 aa, Artificial Sequence
  neuraminidase__InfluenzaA__AEN55476
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVSWSWPDGAELPFTIDK

SEQ ID NO: 21025 - protein, 469 aa, Artificial Sequence; identical to SEQ ID NO: 20257
  neuraminidase__InfluenzaA__AEN55486

SEQ ID NO: 21026 - protein, 469 aa, Artificial Sequence; identical to SEQ ID NO: 20257
  neuraminidase__InfluenzaA__AEN55506

SEQ ID NO: 21027 - protein, 469 aa, Artificial Sequence
  neuraminidase__InfluenzaA__AEN55516
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSRGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21028 - protein, 469 aa, Artificial Sequence; identical to SEQ ID NO: 20257
  neuraminidase__InfluenzaA__AEN55526

SEQ ID NO: 21029 - protein, 469 aa, Artificial Sequence; identical to SEQ ID NO: 20786
  neuraminidase__InfluenzaA__AEN69429

SEQ ID NO: 21030 - protein, 469 aa, Artificial Sequence; identical to SEQ ID NO: 20783
  neuraminidase__InfluenzaA__AEN69438

SEQ ID NO: 21031 - protein, 469 aa, Artificial Sequence; identical to SEQ ID NO: 19013
  neuraminidase__InfluenzaA__AEN69484

SEQ ID NO: 21032 - protein, 469 aa, Artificial Sequence; identical to SEQ ID NO: 16685
  neuraminidase__InfluenzaA__AEO01627

SEQ ID NO: 21033 - protein, 469 aa, Artificial Sequence; identical to SEQ ID NO: 16685
  neuraminidase__InfluenzaA__AEO01638

SEQ ID NO: 21034 - protein, 469 aa, Artificial Sequence
  neuraminidase__InfluenzaA__AEO01644
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKTDSSSSGHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21035 - protein, 469 aa, Artificial Sequence
  neuraminidase__InfluenzaA__AEO01654
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETKVLWTSNSIVVFCGTSGTYGTGSWPDGAEINLMPI

SEQ ID NO: 21036 - protein, 470 aa, Artificial Sequence; identical to SEQ ID NO: 16632
  neuraminidase__InfluenzaA__AEO01665

SEQ ID NO: 21037 - protein, 470 aa, Artificial Sequence
  neuraminidase__InfluenzaA__AEO01676
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSIFFRGDNSDTANWSWPDGAEMTFTIDK

SEQ ID NO: 21038 - protein, 469 aa, Artificial Sequence; identical to SEQ ID NO: 16685
  neuraminidase__InfluenzaA__AEO01693

SEQ ID NO: 21039 - protein, 470 aa, Artificial Sequence; identical to SEQ ID NO: 16632
  neuraminidase__InfluenzaA__AEO01711

SEQ ID NO: 21040 - protein, 469 aa, Artificial Sequence; identical to SEQ ID NO: 20808
  neuraminidase__InfluenzaA__AEO37533

SEQ ID NO: 21041 - protein, 469 aa, Artificial Sequence
  neuraminidase__InfluenzaA__AEO37543
MNPNQKIITIGSVCMTIGMANLILQIGNIISIWISHSIQLGNQNQIEPCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSVKQDIIGINEWSGYSGSFVQHPELTGLDCIRPCFWVELIRGRPKENTIWTSGSSISFCGVNSDTVGWSWPDGAELPFTIDK

SEQ ID NO: 21042 - protein, 469 aa, Artificial Sequence; identical to SEQ ID NO: 20257
  neuraminidase__InfluenzaA__AEO72179

SEQ ID NO: 21043 - protein, 449 aa, Artificial Sequence
  neuraminidase__InfluenzaA__AEO88957
MNPNQKIITIGSICMVIGIVSLMLQIGNMISIWVSHSTQTGNQHQAEPIRNTNFLTENAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSNFSVKQDIVAITDWSGYSGSFVQHPELTGLDCIRPCFWVELIRGRPKESTIWTSGSSISFCGVNSDTVSWSWPDGAELPFTIDK

SEQ ID NO: 21044 - protein, 449 aa, Artificial Sequence
  neuraminidase__InfluenzaA__AEO88965
MNPNQKIITIGSICMVIEIVSLMLQIGNMISIWVSHSIQTKNQRQAEPISNTKFLTEKAVASVTLAGNSSLCPISGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLNCIRPCFWVELVRGRPKESTIWTSGSSISFCGVNSDTVGWSWPDGAELPFTIDK

SEQ ID NO: 21045 - protein, 449 aa, Artificial Sequence
  neuraminidase__InfluenzaA__AEO88973
MNPNQKIITIGSICMVIGIVSLMLQIGNMISLWVSHSIQTGNQHQVEPISNTNFLTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGMITDTIKSWRNNILRTQESECACVNGSCFTVMTDGPSNGQASYKIFKMEKGRVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSPNSRSGFEMIWDPNGWIETDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 21046 - protein, 449 aa, Artificial Sequence
  neuraminidase__InfluenzaA__AEO88982
MNPNQKIITIGSICMVIGIVSLMLQIGNMISIWVSHSIQTGNQHQAEPIRNTNFLTENAVASVTLAGNSSLCPVRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGIFGDNPRPHDGTGSCGPVSPNGAYGIKGFSFKYGNGVWIGRTKSTNSRSGFEMIWDPNGWTGTDSNFSVKQDIVAITDWSGYSGSFVQHPELTGLDCIRPCFWVELIRGRPKESTIWTSGSSISFCGVNSDTVSWSWPDDAELPFTIDK

SEQ ID NO: 21047 - protein, 449 aa, Artificial Sequence
  neuraminidase__InfluenzaA__AEO88990
MNPNQKIITIGSICMVIGIVSLMLQIGNMISIWVSHSIQTGNQHQAEPIRNTNFLTENAVASVTLAGNSSLCPVRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSNFSVKQDIVAITDWSGYSGSFVQHPELTGLDCIRPCFWVELIRGRPKESTIWTSGSSISFCGVNSDTVSWSWPDDAELPFTIDK

SEQ ID NO: 21048 - protein, 449 aa, Artificial Sequence
  neuraminidase__InfluenzaA__AEO88998
MNPNQKIITIGSICMVIGIVSLMLQIGNMISIWVSHSIQTGNQHQAEPIRNTNFLTENAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNEQASYKIFKMEKGKVVKSVELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSNFSVKQDIVAITDWSGYSGSFVQHPELTGLDCIRPCFWVELIRGRPKESTIWTSGSSISFCGVNSDTVSWSWPDGAELPFTIDK

SEQ ID NO: 21049 - protein, 449 aa, Artificial Sequence
  neuraminidase__InfluenzaA__AEO89006
MNPNQKIITIGSICMVIGIVSLMLQIGNMISIWVSHSIQTGNQHQAEPIRNTNFLTENAVASVTLAGNSSLCPVRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSDFSVKQDIIAITDWSGYSGSFVQHPELTGLDCIRPCFWVELIRGRPKESTIWTSGSSISFCGVNSDTVSWSWPDGAELPFTIDK

SEQ ID NO: 21050 - protein, 449 aa, Artificial Sequence
  neuraminidase__InfluenzaA__AEO89023
MNPNQKIITIGSICMVIGIVSLMLQIGNMVSLWVSHSIQTGNQHQVEPISNTNFLTEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGMITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSPSSRSGFEMIWDPNGWTETDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 21051 - protein, 449 aa, Artificial Sequence
  neuraminidase__InfluenzaA__AEO89032
MNPNQKIITIGSICMVIGIVSLMLQIGNMISIWVSHSIQTGNQHQAEPIRNTNFLTENAVASVTLAGNSSLCPVRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSNFSVKQDIVAITDWSGYSGSFVQHPELTGLDCIRPCFWVELIRGRPKESTIWTSGSSISFCGVNSDTVSWSWPDGAELPFTIDK

SEQ ID NO: 21052 - protein, 449 aa, Artificial Sequence
  neuraminidase__InfluenzaA__AEO89041
MNPNQKIITIGSICMVIGLVSLMLQIGNMISIWVSHSIQTGNQHQAEPIRNTNFLTENAVASVTLAGNSSLCPVRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSNFSVKQDIVAITDWSGYSGSFVQHPELTGLDCIRPCFWIELIRGRPKESTIWTSGSSISFCGVNSDTVSWSWPDGAELPFTIDK

SEQ ID NO: 21053 - protein, 449 aa, Artificial Sequence
  neuraminidase__InfluenzaA__AEO89050
MNPNQKIITIGSICMVIGIVSLMLQIGNMISIWVSHSIQTGNQHQAEPIRNTNFLTENAVASVTLAGNSSLCPIRGWAVHSKDNSIRIGSKGDVFVIREPFISCSHLECRTFFLTQGALLNDKHSNGTVKDRSPHRTLMSCPMGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSDFSVKQDIVAITDWSGYSGSFVQHPELTGLDCIRPCFWVELIRGRPKESTIWTSGSSISFCGVNSDTVSWSWPDGAELPFTIDK

SEQ ID NO: 21054 - protein, 449 aa, Artificial Sequence
  neuraminidase__InfluenzaA__AEO89058
MNPNQKIITIGSICMVIGIVSLMLQIGNMISIWVSHSIQTGNQRQAEPISNTKFLTEKAVASVTLAGNSSLCPISGWAVYSKDNSIRIGSRGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELDAPNYHYEECSCYPDAGEITCVCRDNWHGSNRPWVSFNQNLDYQIGYICSGVFGDNPRPNDGTGSCGPVSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 21055 - protein, 449 aa, Artificial Sequence
  neuraminidase__InfluenzaA__AEO89075
MNPNQKIITIGSICMVIGIVSLMLQIGNMISIWVSHSIQRGNLNQVEPISNTNFLTEKAVASVTLAGNSSLCPIRGWAIHSKDNSIRIGSKGDVFVIREPFISCSHLECRTFFLTQGALLNDKHSNGTVKDRSPHRTLMSCPVGEVPSPYNSRFESVAWSASACHDGTSWLTIGISGPDNGAVAVVKYNGIITDTIKSWRNNILRTQESECACVNGSCFTVMTDGPSNGQASYKIFKMEKGKVIKSVELDAPNYHYEECSCYPDAGEITCVCRDNWHGSNRPWVSFNQNLEYQIGYICSGVFGDNPRPNDGTGSCGPVSPNGAYGVKGFSFKYGNGVWIGRTKSPNSRSGFEMIWDPNGWSETDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 21056 - protein, 449 aa, Artificial Sequence
  neuraminidase__InfluenzaA__AEO89084
MNPNQKIITIGSICMVIGIVSLMLQIGNMISIWISYSIQTGNQHQAEPTRNATFLTENAVASVTLAGNSSLCPVRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSDGQASYKIFKMEKGKVVKSVELIAPNYHYEECSCYPDAGEITCVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTETDSNFSVKQDIVAITDWSGYSGSFVQHPELTGLDCIRPCFWVELIRGRPKESTIWTSGSSISFCGVNSDTVSWSWPDGAELPFTIDK

SEQ ID NO: 21057 - protein, 449 aa, Artificial Sequence
  neuraminidase__InfluenzaA__AEO89093
MNPNQKIITIGSICMVIGIVSLMLQIGNMISLWVSHSIQTGNQHQVEPISNTNFLVEKAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGMITDTIKSWRNNILRTQESECACVNGSCFTVMTDGPSNGQASYKIFKMEKGRVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSPNSRSGFEMIWDPNGWTETDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 21058 - protein, 449 aa, Artificial Sequence
  neuraminidase__InfluenzaA__AEO89102
MNPNQKIITIGSICMVIGIVSLMLQIGNMISIWISHSIQTGNQNQVEPISNTNFLTEKAVASVILAGNSSLCPIRGWAIHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDSGAVAVLKYNGIITDTIKSWRNNILRTQESECACVNGSCFTVMTDGPSNGQASYKIFKMEKGKVIKSVELDAPNYHYEECSCYPDAGEITCVCRDNWHGSNRPWVSFNQNLEYQIGYICSGVFGDNPRPNDGTGSCGPVSHNGAYGVKGFSFKYGNGVWIGRTKSPNSRSGFEMIWDPNGWSETDSSFSVKQDIVAITDWSGYSGSFVQHPELTGLDCIRPCFWVELIRGRPKESTVWTSGSSISFCGVNSDTVSWSWPDGAELPFTIDK

SEQ ID NO: 21059 - protein, 449 aa, Artificial Sequence
  neuraminidase__InfluenzaA__AEO89111
MNPNQKIITIGSICMVIGIVSLMLQIGNIISIWVSHSIQTGNQHQDEPIRNANVLTENAVASVTLAGNSSLCPVRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGVFGDNPRPNDGTGSCDPVSPNGAYGIKGFSFKYGNGVWIGRTKSTNSRSGFEMIWDPNGWTETDSNFSVKQDIVAITDWSGYSGSFVQHPELTGLDCIRPCFWVELIRGRPKESTIWTSGSSISFCGVNSDTVSWSWPDGAELPFTIDK

SEQ ID NO: 21060 - protein, 449 aa, Artificial Sequence
  neuraminidase__InfluenzaA__AEO89120
MNPNQKIITIGSICMVIGIVSLMLQIGNMISIWVSHSIQTGNQHQAEPIRNASFLTENAVASVTLAGNSSLCPVRGWAVHSKDNSIRIGSKGDVFVIREPFISCSHLECRTFFLTQGALLNDKHSNGTVKDRSPHRTLMSCPVGEAPSPYNSRFESVAWSASACHDGISWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGVFGDNPRPNDGTGSCGPVSPNGAYGIKGFSFKYGNGVWIGRTKSTNSRSGFEMIWDPNGWAETDSNFSVKQDIVAITDWSGYSGSFVQHPELTGLDCIRPCFWVELIRGRPKEGTIWTSGSSISFCGVNSDTVSWSWPDGAELPFTIDK

SEQ ID NO: 21061 - protein, 449 aa, Artificial Sequence
  neuraminidase__InfluenzaA__AEO89129
MNPNQKIITIGSICMVIGIVSLMLQIGNIISIWVSHSTQTGNQHQDEPIRNANFLTENAVASVTLAGNSSLCPVRGWAVHSKDNSIRVGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGVFGDNPRPNDGTGSCDPVSPNGAYGIKGFSFKYGNGVWIGRTKSTNSRSGFEMIWDPNGWTETDSNFSVKQDIVAITDWSGYSGSFVQHPELTGLDCIRPCFWVELIRGRPKESTIWTSGSSISFCGVNSDTVSWSWPDGAELPFTIDK

SEQ ID NO: 21062 - protein, 449 aa, Artificial Sequence
  neuraminidase__InfluenzaA__AEO89138
MNPNQKIITIGSICMVTGIVSLMLQIGNIISMWVSHSIQTRNQHQAEPIRNTNFLTENAVASVTLTGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDNDFSVKQDIVAITDWSGYSGSFVQHPELTGLDCIRPCFWVELIRGRPKESTVWTSGSSISFCGVNSDTVSWSWPDGAELPFTIDK

SEQ ID NO: 21063 - protein, 449 aa, Artificial Sequence
  neuraminidase__InfluenzaA__AEO89156
MNPNQKIITIGSICMVTGIVSLMLQIGNITSMWVSHSIQTRNQHQAEPIRNTNFLTENAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSDFSVKQDIVAITDWSGYSGSFVQHPELTGLDCIRPCFWVELIRGRPKESTIWTSGSSISFCGVNSDTVSWSWPDGAELPFTIDK

SEQ ID NO: 21064 - protein, 449 aa, Artificial Sequence
  neuraminidase__InfluenzaA__AEO89174
MNPNQKIITIGSICMVTGIVSLMLQIGNIISMWVSHSIQTRNQHQAEPIRNTNFLTENAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSDFSVKQDIVAITDWSGYSGSFVQHPELTGLDCIRPCFWVELIRGRPKESTIWTSGSSISFCGVNSDTVSWSWPDGAELPFTIDK

SEQ ID NO: 21065 - protein, 449 aa, Artificial Sequence
  neuraminidase__InfluenzaA__AEO89183
MNPNQKIVTIGSICMVIGIVSLMLQIGNMISIWVSHSIQTGNQHQTEPIRNTNFLTENTVASVTLAGNSSLCPIRGWAVHSKDNSIRIGSKGDVFVIREPFISCSHLECRTFFLTQGALLNDKHSNGTVKDRSPHRTLMSCPIGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEIICVCRDNWHGSNRPWVSFNQNLEYQIGYICSGVFGDNPRPNDGKGSCGPVSPNGAYGVKGFSFKYGNGVWIGRTKSTHSRSGFEMIWDPNGWTGTDSEFSMKQDIVAITDWSGYSGSFVQHPELTGLDCIRPCFWVELIRGRPKESTIWTSGSSISFCGVNSDTVSWSWPDGAELPFTIDK

SEQ ID NO: 21066 - protein, 449 aa, Artificial Sequence
  neuraminidase__InfluenzaA__AEO89205
MNPTQKIITIGSICMVIGIVSLMLQIGNMISIWVSHSIQTGNQHQAEPIRNASFLTENAVASVTLAGNSSLCPVRGWAVHSKDNSIRIGSKGDVFVIREPFISCSHLECRTFFLTQGALLNDKHSNGTVKDRSPHRTLMSCPVGEAPSPYNSRFESVAWSASACHDGISWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGVFGDNPRPNDGTGSCGPVSPNGAYGIKGFSFKYGNGVWIGRTKSTNSRSGFEMIWDPNGWAETDSNFSVKQDIVAITDWSGYSGSFVQHPELTGLDCIRPCFWVELIRGRPKEGTIWTSGSSISFCGVNSDTVSWSWPDGAELPFTIDK

SEQ ID NO: 21067 - protein, 449 aa, Artificial Sequence
  neuraminidase__InfluenzaA__AEO89215
MNPNQKIITIGSICMAIGIVSLMLQIGNMISIWVSHSIQTGNQHQAEPIRNASFLTENAVASVTLAGNSSLCPVRGWAVHSKDNSIRIGSKGDVFVIREPFISCSHLECRTFFLTQGALLNDKHSNGTVKDRSPHRTLMSCPVGEAPSPYNSRFESVAWSASACHDGISWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGVFGDNPRPNDGTGSCGPVSPNGAYGIKGFSFKYGNGVWIGRTKSTNSRSGFEMIWDPNGWAETDSNFSVKQDIVAITDWSGYSGSFVQHPELTGLDCIRPCFWVELIRGRPKEGTIWTSGSSISFCGVNSDTVSWSWPDGAELPFTIDK

SEQ ID NO: 21068 - protein, 449 aa, Artificial Sequence
  neuraminidase__InfluenzaA__AEO89226
MNPTQKIITIGSICMAIGIVSLMLQIGNMISIWVSHSIQTGNQHQAEPIRNASFLTENAVASVTLAGNSSLCPVRGWAVHSKDNSIRIGSKGDVFVIREPFISCSHLECRTFFLTQGALLNDKHSNGTVKDRSPHRTLMSCPVGEAPSPYNSRFESVAWSASACHDGISWLTIGISGPDNGAVAVLKYNGIITDTIKSWRNNILRTQESECACVNGSCFTVMTDGPSNGQASYKIFKMEKGKVVKSVELNAPNYHYEECSCYPDAGEITCVCRDNWHGSNRPWVSFNQNLEYQIGYICSGVFGDNPRPNDGTGSCGPVSPNGAYGIKGFSFKYGNGVWIGRTKSTNSRSGFEMIWDPNGWAETDSNFSVKQDIVAITDWSGYSGSFVQHPELTGLDCIRPCFWVELIRGRPKEGTIWTSGSSISFCGVNSDTVSWSWPDGAELPFTIDK

SEQ ID NO: 21069 - protein, 449 aa, Artificial Sequence
  neuraminidase__InfluenzaA__AEO89237
MNPNQKIITIGSICMVIGIVSLMLQIGNIISMWVSHSIQTRNQHQAEPIRNTNFLTENAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSDFSVKQDIVAITDWSGYSGSFVQHPELTGLDCIRPCFWVELIRGRPKESTIWTSGSSISFCGVNSDTVSWSWPDGAELPFTIDK

SEQ ID NO: 21070 - protein, 449 aa, Artificial Sequence
  neuraminidase__InfluenzaA__AEO89248
MNPNQKIITIGSICMVIGIVSLMLQIGNIISIWVSHSFQTRVQHQAEPIRNTNFLTENAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMKKGKVVKSVELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSDFSMKQDIVAITDWSGYSGSFVQHPELTGLDCIRPCFWVELIRGRPKESTIWTSGSSISFCGVNSDTVSWSWPDGAELPFTIDK

SEQ ID NO: 21071 - protein, 449 aa, Artificial Sequence
  neuraminidase__InfluenzaA__AEO89270
MNPNQKIITIGSICMVTGIVSLMLQIGNITSMWVSHSIQTRNQHQAEPIRNTNFLTENAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSVELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSDFSVKQDIVAITDWSGYSGSFVQHPELTGLDCIRPCFWVELIRGRPKESTIWTSGSSISFCGVNSDTVGWSWPDGAELPFTIDK

SEQ ID NO: 21072 - protein, 449 aa, Artificial Sequence
  neuraminidase__InfluenzaA__AEO89281
MNPNQKIITIGSICMVVGIVSLMLQIGNIVSIWVSHSIQTGHQQQAEPIKNTNFLTKNAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNTLRTQESECACVNGSCFTVMTDGPSNGQASYKIFKMEKGKVVKSAELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSNFSMKQDIVAITEWSGYSGSFVQHPELTGLDCIRPCFWVELIRGRPKESTIWTSGSSISFCGVNSDTVSWSWPDGAELPFTIDK

SEQ ID NO: 21073 - protein, 449 aa, Artificial Sequence
  neuraminidase__InfluenzaA__AEO89291
MNPNQKIITIGSICMVVGIVSLMLQIGNIVSIWVSHSIQTGHQQQAEPIKNTNFLTENAVASVTLAGNSSLCPIRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVKSAELNAPNYHYEECSCYPDAGEIICVCRDNWHGSNRPWVSFNQNLEYQIGYICSGVFGDNPRPNDGTGSCGPVSPNGAYGIKGFSFKYGNGVWIGRTKSTNSRSGFEMIWDPNGWTGTDSNFSMKQDIVAITEWSGYSGSFVQHPELTGLDCIRPCFWVELIRGRPKESTIWTSGSSISFCGVNSDTVSWSWPDGAELPFTIDK

SEQ ID NO: 21074 - protein, 449 aa, Artificial Sequence
  neuraminidase__InfluenzaA__AEO89302
MNPNQKIITIGSICMVIGIVSLMLQIGNIISIWVSHSIQTGNQHQDEPIRNANFLTENAVASVTLAGNSSLCPVRGWAVHSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASYKIFKMEKGKVVRSVELNAPNYHYEECSCYPDAGEITCVCRDNWHGSNRPWVSFNQNLEYQIGYICSGVFGDNPRPNDGTGSCDPVSPNGAYGIKGFSFKYGNGVWIGRTKSTNSRSGFEMIWDPNGWTETDSDFSVKQDIVAITDWSGYSGSFVQHPELTGLDCIRPCFWVELIRGRPKESTIWTSGSSISFCGVSSDTVSWSWPDGAELPFTIDK

SEQ ID NO: 21075 - protein, 469 aa, Artificial Sequence; identical to SEQ ID NO: 16057
  neuraminidase__InfluenzaA__AEO99218

SEQ ID NO: 21076 - protein, 469 aa, Artificial Sequence
  neuraminidase__InfluenzaA__AEQ49739
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEVTCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGMDCIRPCFWVELIRGRPKENTIWTSGSSISFCGVNSDTVGWSWPDGAELPFTIDK

SEQ ID NO: 21077 - protein, 469 aa, Artificial Sequence; identical to SEQ ID NO: 20257
  neuraminidase__InfluenzaA__AEQ49740

SEQ ID NO: 21078 - protein, 469 aa, Artificial Sequence
  neuraminidase__InfluenzaA__AEQ49741
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGMDCIRPCFWVELIRGRPKENTIWTSGSSISFCGVNSDTVGWSWPDGAELPFTIDK

SEQ ID NO: 21079 - protein, 469 aa, Artificial Sequence
  neuraminidase__InfluenzaA__AEQ49742
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIHSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGMDCIRPCFWVELIRGRPKENTIWTSGSSISFCGVNSDTVGWSWPDGAELPFTIDK

SEQ ID NO: 21080 - protein, 469 aa, Artificial Sequence
  neuraminidase__InfluenzaA__AEQ49743
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGTNEWSGYSGSFVQHPELTGLDCIRPCFWVELIRGRPKENTIWTSGSSISFCGVNSDTVGWSWPDGAELPFTIDN

SEQ ID NO: 21081 - protein, 469 aa, Artificial Sequence
  neuraminidase__InfluenzaA__AEQ49744
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALVNDKHSNGTIKDRSPYRTLMSCPIGEVPSPYNSRFESVAWSASACHDGINWLTIGISGPDNGAVAVLKYNGIITDTIKSWRNNIFRTQESECACVNGSCFTIMTDGPSDGQASYKIFRIEKGKIVKSVEMNAPNYHYEECSCYPDSSEITCVCRDNWHGSNRPWVSFNQDLEYQIGYICSGIFGDNPRPNDKTGSCGPVSSNGANGVKGFSFKYGNGVWIGRTKSISSRKGFEMIWDPNGWTGTDNNFSIKQNIVGINEWSGYSGSFVQHPELTGLDCIRPCFWVELIRGRPKENTIWTSGSSISFCGVNSDTVGWSWPDGAELPFTIDK

SEQ ID NO: 21082 - protein, 469 aa, Artificial Sequence; identical to SEQ ID NO: 21078
  neuraminidase__InfluenzaA__AEQ49745

SEQ ID NO: 21083 - protein, 469 aa, Artificial Sequence; identical to SEQ ID NO: 21078
  neuraminidase__InfluenzaA__AEQ49746

SEQ ID NO: 21084 - protein, 469 aa, Artificial Sequence; identical to SEQ ID NO: 21078
  neuraminidase__InfluenzaA__AEQ49747

SEQ ID NO: 21085 - protein, 469 aa, Artificial Sequence; identical to SEQ ID NO: 20257
  neuraminidase__InfluenzaA__AEQ49748

SEQ ID NO: 21086 - protein, 469 aa, Artificial Sequence; identical to SEQ ID NO: 21078
  neuraminidase__InfluenzaA__AEQ49749

SEQ ID NO: 21087 - protein, 469 aa, Artificial Sequence
  neuraminidase__InfluenzaA__AEQ49750
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDNHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKNISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21088 - protein, 469 aa, Artificial Sequence
  neuraminidase__InfluenzaA__AEQ49751
MNPNQKIITIGSVCMTIGMANLILQIGNIISIWISHSFQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDNHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGMDCIRPCFWVELIRGRPKENTIWTSGSSISFCGVNSDTVGWSWPDGAELPFTIDK

SEQ ID NO: 21089 - protein, 469 aa, Artificial Sequence
  neuraminidase__InfluenzaA__AEQ49752
MNPNQKIITIGSVCMTIGMANLILQIGNIISIWISHSIQLGNQSQIGTCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGMDCIRPCFWVELIRGRPKENTIWTSGSSISFCGVNSDTVGWSWPDGAELPFTIDK

SEQ ID NO: 21090 - protein, 469 aa, Artificial Sequence
  neuraminidase__InfluenzaA__AEQ49753
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGMDCIRPCFWVELIRGRPKENTIWTSGSSISFCGVNSDTVDWSWPDGAELPFTIDK

SEQ ID NO: 21091 - protein, 469 aa, Artificial Sequence
  neuraminidase__InfluenzaA__AEQ49754
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSNTVGWSWPDGAELPFTIDK

SEQ ID NO: 21092 - protein, 469 aa, Artificial Sequence; identical to SEQ ID NO: 21078
  neuraminidase__InfluenzaA__AEQ49755

SEQ ID NO: 21093 - protein, 469 aa, Artificial Sequence
  neuraminidase__InfluenzaA__AEQ49756
MNPNQKIITIGSVCMTIGMANLILQIGNIISIWISHSIQLGNQSQVETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21094 - protein, 469 aa, Artificial Sequence; identical to SEQ ID NO: 21078
  neuraminidase__InfluenzaA__AEQ49757

SEQ ID NO: 21095 - protein, 469 aa, Artificial Sequence
  neuraminidase__InfluenzaA__AEQ49758
MNPNQKIITIGSVCMTIGMANLILQIGNIISIWISHSIQLGNHSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWAGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21096 - protein, 469 aa, Artificial Sequence; identical to SEQ ID NO: 21078
  neuraminidase__InfluenzaA__AEQ49759

SEQ ID NO: 21097 - protein, 469 aa, Artificial Sequence; identical to SEQ ID NO: 21078
  neuraminidase__InfluenzaA__AEQ49760

SEQ ID NO: 21098 - protein, 469 aa, Artificial Sequence
  neuraminidase__InfluenzaA__AEQ49761
MNPNQKIITIGSVCMTIGMANLILQIGNIISIWISHSIQLGNQSQIETCNQSVITYENNTWLNQTYVNISNTNFAAGQSVVSVKLAGNSSLCPVSGWAIYSKDNSIRIGSKGDVFVIREPFISCSPSECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRSKENTIWTSGSSISFCGVNSDTVGWSWPDGAELPFTIDK

SEQ ID NO: 21099 - protein, 469 aa, Artificial Sequence
  neuraminidase__InfluenzaA__AEQ49762
MNPNQKIITIGSVCMTIGMANLILQIGNIISIWISHSIQLGNQSQIETCNQSVITYENNTWINQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFIIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21100 - protein, 469 aa, Artificial Sequence; identical to SEQ ID NO: 21078
  neuraminidase__InfluenzaA__AEQ49763

SEQ ID NO: 21101 - protein, 469 aa, Artificial Sequence; identical to SEQ ID NO: 21078
  neuraminidase__InfluenzaA__AEQ49764

SEQ ID NO: 21102 - protein, 469 aa, Artificial Sequence; identical to SEQ ID NO: 21078
  neuraminidase__InfluenzaA__AEQ49765

SEQ ID NO: 21103 - protein, 469 aa, Artificial Sequence
  neuraminidase__InfluenzaA__AEQ49766
MNPNQKIITIGSVCMTIGMANLILQIGNIISIWISHSIQLGNQSQIETCNQSVITYENNTWVNQTYVNISNTNFAAGQSVVSVKLTGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21104 - protein, 469 aa, Artificial Sequence
  neuraminidase__InfluenzaA__AEQ49767
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSYKYGNGVWIGRTKSISSRKGFEMIWDPNGWTGTDNNFSIKQDIVGINEWSGYSGSFVQHPELTGMGCIRPCFWVELIRGRPKENTIWTSGSSISFCGVNSDTVGWSWPDGAELPFTIDK

SEQ ID NO: 21105 - protein, 469 aa, Artificial Sequence; identical to SEQ ID NO: 20257
  neuraminidase__InfluenzaA__AEQ49768

SEQ ID NO: 21106 - protein, 469 aa, Artificial Sequence; identical to SEQ ID NO: 21078
  neuraminidase__InfluenzaA__AEQ49769

SEQ ID NO: 21107 - protein, 469 aa, Artificial Sequence
  neuraminidase__InfluenzaA__AEQ49770
MNPNQKIITIGSVCMTIGMANLILQIGNIISVWISHSIQLGNQNQTETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTVDK

SEQ ID NO: 21108 - protein, 469 aa, Artificial Sequence; identical to SEQ ID NO: 21091
  neuraminidase__InfluenzaA__AEQ49771

SEQ ID NO: 21109 - protein, 469 aa, Artificial Sequence; identical to SEQ ID NO: 20257
  neuraminidase__InfluenzaA__AEQ49772

SEQ ID NO: 21110 - protein, 469 aa, Artificial Sequence
  neuraminidase__InfluenzaA__AEQ49773
MNPNQKIITIGSICMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSNTVGWSWPDGAELPFTIDK

SEQ ID NO: 21111 - protein, 469 aa, Artificial Sequence
  neuraminidase__InfluenzaA__AEQ49774
MNPNQKIITIGSVCMTIGMANLILQIGNIISIWISHSIQLGNQSQIETCNQSVITYEYNTWVNQTYINISNTNFAAGQSVVSVKLVGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGYEMIWDPNGWTGTDNNFSIKQDIVGINEWSGYSGSFVQHPELTGMDCIRPCFWVELIRGRPKENTIWTSGSSISFCGVNSDTVGWSWPDGAELPFTIDK

SEQ ID NO: 21112 - protein, 469 aa, Artificial Sequence; identical to SEQ ID NO: 20257
  neuraminidase__InfluenzaA__AEQ49775

SEQ ID NO: 21113 - protein, 469 aa, Artificial Sequence
  neuraminidase__InfluenzaA__AEQ49776
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPSECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPTENTIWTSGSSISFCGVNSDTVGWSWPDGAELPFTIDK

SEQ ID NO: 21114 - protein, 469 aa, Artificial Sequence; identical to SEQ ID NO: 21078
  neuraminidase__InfluenzaA__AEQ49777

SEQ ID NO: 21115 - protein, 469 aa, Artificial Sequence
  neuraminidase__InfluenzaA__AEQ49778
MNPNQKIITIGSVCMTIGMANLILQIGNIISIWISHSIQLGNQSQIETCNQSVITYENNTWINQTYVNISNTNFAAVQSVVSVKLAGNSTLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21116 - protein, 469 aa, Artificial Sequence
  neuraminidase__InfluenzaA__AEQ49779
MNPNQKIITIGSVCMTIGMANLILQIGNIISIWISHSIQLGNQNQTETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTVDK

SEQ ID NO: 21117 - protein, 469 aa, Artificial Sequence; identical to SEQ ID NO: 20257
  neuraminidase__InfluenzaA__AEQ49780

SEQ ID NO: 21118 - protein, 469 aa, Artificial Sequence; identical to SEQ ID NO: 20257
  neuraminidase__InfluenzaA__AEQ49781

SEQ ID NO: 21119 - protein, 469 aa, Artificial Sequence; identical to SEQ ID NO: 21078
  neuraminidase__InfluenzaA__AEQ49782

SEQ ID NO: 21120 - protein, 469 aa, Artificial Sequence
  neuraminidase__InfluenzaA__AEQ49783
MNPNQKIITIGSACMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21121 - protein, 469 aa, Artificial Sequence
  neuraminidase__InfluenzaA__AEQ49785
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCFDPNDEEGGHGVKGWAFDDGNDVWMGRTISEKSRLGYETFKVIEGWSNPKSKLQINRQVIVDRGDRSGYSGIFSVEGKSCINRCFYVELIRGSKEETEVLWTSNSIVVFCGTSGTYGTGSWPDGADINLMPI

SEQ ID NO: 21122 - protein, 469 aa, Artificial Sequence; identical to SEQ ID NO: 21121
  neuraminidase__InfluenzaA__AEQ49786

SEQ ID NO: 21123 - protein, 469 aa, Artificial Sequence; identical to SEQ ID NO: 21121
  neuraminidase__InfluenzaA__AEQ49788

SEQ ID NO: 21124 - protein, 469 aa, Artificial Sequence; identical to SEQ ID NO: 21121
  neuraminidase__InfluenzaA__AEQ49789

SEQ ID NO: 21125 - protein, 469 aa, Artificial Sequence
  neuraminidase__InfluenzaA__AEQ49790
MNPNQKIITIGSVSLTISTICFFMQIAILITTVTLHFKQYEFYSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRGRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21126 - protein, 469 aa, Artificial Sequence
  neuraminidase__InfluenzaA__AEQ49791
MNPNQKIITIGSVSLTISTICFFMQIAILITTVTLHFKQYEFYPPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRNRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21127 - protein, 469 aa, Artificial Sequence; identical to SEQ ID NO: 21121
  neuraminidase__InfluenzaA__AEQ49792

SEQ ID NO: 21128 - protein, 469 aa, Artificial Sequence; identical to SEQ ID NO: 21121
  neuraminidase__InfluenzaA__AEQ49793

SEQ ID NO: 21129 - protein, 469 aa, Artificial Sequence; identical to SEQ ID NO: 21121
  neuraminidase__InfluenzaA__AEQ49794

SEQ ID NO: 21130 - protein, 469 aa, Artificial Sequence; identical to SEQ ID NO: 21121
  neuraminidase__InfluenzaA__AEQ49795

SEQ ID NO: 21131 - protein, 469 aa, Artificial Sequence
  neuraminidase__InfluenzaA__AEQ49796
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRGRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 21132 - protein, 469 aa, Artificial Sequence; identical to SEQ ID NO: 21121
  neuraminidase__InfluenzaA__AEQ49797

SEQ ID NO: 21133 - protein, 469 aa, Artificial Sequence; identical to SEQ ID NO: 21121
  neuraminidase__InfluenzaA__AEQ49798

SEQ ID NO: 21134 - protein, 469 aa, Artificial Sequence; identical to SEQ ID NO: 21121
  neuraminidase__InfluenzaA__AEQ49799

SEQ ID NO: 21135 - protein, 469 aa, Artificial Sequence; identical to SEQ ID NO: 21121
  neuraminidase__InfluenzaA__AEQ49800

SEQ ID NO: 21136 - protein, 469 aa, Artificial Sequence; identical to SEQ ID NO: 21121
  neuraminidase__InfluenzaA__AEQ49801

SEQ ID NO: 21137 - protein, 469 aa, Artificial Sequence; identical to SEQ ID NO: 21121
  neuraminidase__InfluenzaA__AEQ49802

SEQ ID NO: 21138 - protein, 469 aa, Artificial Sequence
  neuraminidase__InfluenzaA__AEQ49803
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSTSSSHCLDPNNEEGGHGVKGWAFDDGNDVWMGRTISETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMTI

SEQ ID NO: 21139 - protein, 469 aa, Artificial Sequence
  neuraminidase__InfluenzaA__AEQ49804
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21140 - protein, 469 aa, Artificial Sequence
  neuraminidase__InfluenzaA__AEQ49805
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRNRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21141 - protein, 469 aa, Artificial Sequence
  neuraminidase__InfluenzaA__AEQ49806
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSFSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21142 - protein, 469 aa, Artificial Sequence; identical to SEQ ID NO: 19518
  neuraminidase__InfluenzaA__AEQ49807

SEQ ID NO: 21143 - protein, 469 aa, Artificial Sequence
  neuraminidase__InfluenzaA__AEQ49809
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21144 - protein, 469 aa, Artificial Sequence; identical to SEQ ID NO: 21143
  neuraminidase__InfluenzaA__AEQ49811

SEQ ID NO: 21145 - protein, 469 aa, Artificial Sequence; identical to SEQ ID NO: 19518
  neuraminidase__InfluenzaA__AEQ49812

SEQ ID NO: 21146 - protein, 469 aa, Artificial Sequence; identical to SEQ ID NO: 19518
  neuraminidase__InfluenzaA__AEQ49813

SEQ ID NO: 21147 - protein, 469 aa, Artificial Sequence; identical to SEQ ID NO: 19518
  neuraminidase__InfluenzaA__AEQ49815

SEQ ID NO: 21148 - protein, 469 aa, Artificial Sequence
  neuraminidase__InfluenzaA__AEQ49816
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFVEEGKIVHTSTLSGSAQHVEECSCYPRYPGVRCVCRDNWKGSNRPIVDINMKDHSIVSSYVCSGLVGDTPRKNDSSSSSHCFDPNDEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21149 - protein, 469 aa, Artificial Sequence; identical to SEQ ID NO: 20883
  neuraminidase__InfluenzaA__AEQ49820

SEQ ID NO: 21150 - protein, 469 aa, Artificial Sequence; identical to SEQ ID NO: 20883
  neuraminidase__InfluenzaA__AEQ49821

SEQ ID NO: 21151 - protein, 469 aa, Artificial Sequence; identical to SEQ ID NO: 21121
  neuraminidase__InfluenzaA__AEQ49822

SEQ ID NO: 21152 - protein, 469 aa, Artificial Sequence; identical to SEQ ID NO: 21121
  neuraminidase__InfluenzaA__AEQ49823

SEQ ID NO: 21153 - protein, 469 aa, Artificial Sequence; identical to SEQ ID NO: 21121
  neuraminidase__InfluenzaA__AEQ49824

SEQ ID NO: 21154 - protein, 469 aa, Artificial Sequence; identical to SEQ ID NO: 21121
  neuraminidase__InfluenzaA__AEQ49825

SEQ ID NO: 21155 - protein, 469 aa, Artificial Sequence; identical to SEQ ID NO: 21121
  neuraminidase__InfluenzaA__AEQ49826

SEQ ID NO: 21156 - protein, 469 aa, Artificial Sequence; identical to SEQ ID NO: 21121
  neuraminidase__InfluenzaA__AEQ49827

SEQ ID NO: 21157 - protein, 469 aa, Artificial Sequence; identical to SEQ ID NO: 21121
  neuraminidase__InfluenzaA__AEQ49828

SEQ ID NO: 21158 - protein, 469 aa, Artificial Sequence
  neuraminidase__InfluenzaA__AEQ49829
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSALGKADTKILFIEEGKIVHTSTLSGSAQHVEECSCYPRYPGVRCVCRDNWKGSNRPIVDINMKDHSIVSSYVCSGLVGDTPRKNDSSSSSHCFDPNDEEGGHGVKGWAFDDGNDVWMGRTISEKSRLGYETFKVIEGWSNPKSKLQINRQVIVDRGDRSGYSGIFSVEGKSCINRCFYVELIRGSKEETEVLWTSNSIVVFCGTSGTYGTGSWPDGADINLMPI

SEQ ID NO: 21159 - protein, 469 aa, Artificial Sequence; identical to SEQ ID NO: 21121
  neuraminidase__InfluenzaA__AEQ49830

SEQ ID NO: 21160 - protein, 469 aa, Artificial Sequence; identical to SEQ ID NO: 21121
  neuraminidase__InfluenzaA__AEQ49831

SEQ ID NO: 21161 - protein, 469 aa, Artificial Sequence
  neuraminidase__InfluenzaA__AEQ49832
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCFDPNDEEGGHGVKGWAFDDGNDVWMGRTISEKSRLGYETFKVVEGWSNPKSKLQINRQVIVDRGDRSGYSGIFSVEGKSCINRCFYVELIRGSKEETEVLWTSNSIVVFCGTSGTYGTGSWPDGADINLMPI

SEQ ID NO: 21162 - protein, 469 aa, Artificial Sequence
  neuraminidase__InfluenzaA__AEQ49833
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQISRQVIVDRGNRSGYSGIFSVEGKSCINRCFYVELIRGRKEETEVLWTSNSIVVFCGTSGTYGTGSWPDGADLNLMPI

SEQ ID NO: 21163 - protein, 469 aa, Artificial Sequence
  neuraminidase__InfluenzaA__AEQ49835
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCMAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCFDPNDEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21164 - protein, 469 aa, Artificial Sequence; identical to SEQ ID NO: 21163
  neuraminidase__InfluenzaA__AEQ49836

SEQ ID NO: 21165 - protein, 469 aa, Artificial Sequence; identical to SEQ ID NO: 21163
  neuraminidase__InfluenzaA__AEQ49838

SEQ ID NO: 21166 - protein, 469 aa, Artificial Sequence; identical to SEQ ID NO: 21163
  neuraminidase__InfluenzaA__AEQ49839

SEQ ID NO: 21167 - protein, 469 aa, Artificial Sequence
  neuraminidase__InfluenzaA__AEQ49840
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCMAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCFDPNDEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADINLMPI

SEQ ID NO: 21168 - protein, 469 aa, Artificial Sequence; identical to SEQ ID NO: 21163
  neuraminidase__InfluenzaA__AEQ49841

SEQ ID NO: 21169 - protein, 469 aa, Artificial Sequence; identical to SEQ ID NO: 21163
  neuraminidase__InfluenzaA__AEQ49842

SEQ ID NO: 21170 - protein, 469 aa, Artificial Sequence; identical to SEQ ID NO: 21163
  neuraminidase__InfluenzaA__AEQ49843

SEQ ID NO: 21171 - protein, 469 aa, Artificial Sequence; identical to SEQ ID NO: 21121
  neuraminidase__InfluenzaA__AEQ49844

SEQ ID NO: 21172 - protein, 469 aa, Artificial Sequence
  neuraminidase__InfluenzaA__AEQ49845
MNPNQKIITIGSVSLTISTICFFMQIAILITTVTLHFKQYEFNSPPNNQVMLCEPTIIERNITEIVYLTNTTIEREICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCMAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCFDPNDEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21173 - protein, 469 aa, Artificial Sequence
  neuraminidase__InfluenzaA__AEQ49846
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCMAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINLKDHSIVSSYVCSGLVGDTPRKNDSSSSSHCFDPNDEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21174 - protein, 469 aa, Artificial Sequence
  neuraminidase__InfluenzaA__AEQ49850
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCFDPNDEEGGHGVKGWAFDDGNDVWMGRTISEKSRLGYETFKVIEGWSNPKSKLQINRQVIVDRGDRSGYSGIFSVEGKSCINRCFYVELIRGSKEETEVLWTSNSIVVFCGTSGTYGTGSWPDGADIKIMPI

SEQ ID NO: 21175 - protein, 469 aa, Artificial Sequence
  neuraminidase__InfluenzaA__AEQ49851
MNPNQKIITIGSVSLTISTICFFMQIAILITTVTLHFKQYEFNSPPNNQVMLCEPTIMERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21176 - protein, 469 aa, Artificial Sequence; identical to SEQ ID NO: 21143
  neuraminidase__InfluenzaA__AEQ49852

SEQ ID NO: 21177 - protein, 469 aa, Artificial Sequence; identical to SEQ ID NO: 21121
  neuraminidase__InfluenzaA__AEQ49969

SEQ ID NO: 21178 - protein, 469 aa, Artificial Sequence; identical to SEQ ID NO: 21143
  neuraminidase__InfluenzaA__AEQ49970

SEQ ID NO: 21179 - protein, 469 aa, Artificial Sequence
  neuraminidase__InfluenzaA__AEQ54954
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21180 - protein, 469 aa, Artificial Sequence; identical to SEQ ID NO: 16599
  neuraminidase__InfluenzaA__AER08645

SEQ ID NO: 21181 - protein, 469 aa, Artificial Sequence
  neuraminidase__InfluenzaA__AER08649
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKLVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21182 - protein, 469 aa, Artificial Sequence
  neuraminidase__InfluenzaA__AER08657
MNPNQKIITIGSVSLTISTVCFFMQIAILITTVTLHFKQYEFNSPPNNQVMLCEPTIIERNITEIVYLTNTTIEKEMCPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21183 - protein, 469 aa, Artificial Sequence; identical to SEQ ID NO: 16599
  neuraminidase__InfluenzaA__AER08659

SEQ ID NO: 21184 - protein, 469 aa, Artificial Sequence
  neuraminidase__InfluenzaA__AER08661
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGDHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21185 - protein, 469 aa, Artificial Sequence; identical to SEQ ID NO: 19518
  neuraminidase__InfluenzaA__AER08663

SEQ ID NO: 21186 - protein, 469 aa, Artificial Sequence; identical to SEQ ID NO: 19518
  neuraminidase__InfluenzaA__AER08665

SEQ ID NO: 21187 - protein, 469 aa, Artificial Sequence
  neuraminidase__InfluenzaA__AER08669
MNPNQKIITIGSVSLTISTICFFMQIAILITTVTLHFKQYEFNSPPNNQVMLCEPTIIERNITEIVYLTNTTIEKEICPTLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21188 - protein, 469 aa, Artificial Sequence
  neuraminidase__InfluenzaA__AER08671
MNPNQKIITIGSVSLTISTICFFMQIAILITTVTLHFKQYGFNSPPNNQVMLCEPTIIERNITEIVYLTNTTIEKEICPTLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21189 - protein, 469 aa, Artificial Sequence; identical to SEQ ID NO: 19518
  neuraminidase__InfluenzaA__AER08673

SEQ ID NO: 21190 - protein, 469 aa, Artificial Sequence; identical to SEQ ID NO: 19518
  neuraminidase__InfluenzaA__AER08675

SEQ ID NO: 21191 - protein, 469 aa, Artificial Sequence; identical to SEQ ID NO: 19518
  neuraminidase__InfluenzaA__AER08677

SEQ ID NO: 21192 - protein, 469 aa, Artificial Sequence; identical to SEQ ID NO: 19518
  neuraminidase__InfluenzaA__AER08679

SEQ ID NO: 21193 - protein, 469 aa, Artificial Sequence
  neuraminidase__InfluenzaA__AER08681
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNDEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 21194 - protein, 469 aa, Artificial Sequence; identical to SEQ ID NO: 19518
  neuraminidase__InfluenzaA__AER08683

SEQ ID NO: 21195 - protein, 469 aa, Artificial Sequence; identical to SEQ ID NO: 21143
  neuraminidase__InfluenzaA__AER08685

SEQ ID NO: 21196 - protein, 469 aa, Artificial Sequence; identical to SEQ ID NO: 21143
  neuraminidase__InfluenzaA__AER08687

SEQ ID NO: 21197 - protein, 469 aa, Artificial Sequence
  neuraminidase__InfluenzaA__AER08689
MNPNQKIITIGSVSLTISTICFFMQIAILITTVTLHFKQYEFNSPPNNQVTLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKDDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21198 - protein, 469 aa, Artificial Sequence; identical to SEQ ID NO: 21143
  neuraminidase__InfluenzaA__AER08691

SEQ ID NO: 21199 - protein, 469 aa, Artificial Sequence
  neuraminidase__InfluenzaA__AER08693
MNPNQKIITIGSVSLTISTICFFMQIAILITTVTLHFKQYEFNSPPKNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21200 - protein, 469 aa, Artificial Sequence
  neuraminidase__InfluenzaA__AER08697
MNPNQKIITIGSVSLTISTICFFMQIAILITTVTLHFKQYEFNSPPNNQVMLCEPTIIERNITEIVYLTNTTIEKETCPTLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINVTSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21201 - protein, 469 aa, Artificial Sequence; identical to SEQ ID NO: 20997
  neuraminidase__InfluenzaA__AER92714

SEQ ID NO: 21202 - protein, 469 aa, Artificial Sequence; identical to SEQ ID NO: 16738
  neuraminidase__InfluenzaA__AER92721

SEQ ID NO: 21203 - protein, 469 aa, Artificial Sequence; identical to SEQ ID NO: 16738
  neuraminidase__InfluenzaA__AER92724

SEQ ID NO: 21204 - protein, 470 aa, Artificial Sequence
  neuraminidase__InfluenzaA__AET84165
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELSAPNFYYEECSCYPDTGIVMCVCRDNWHGSNRPWVSFNQNLDYQIGYICSGVFGDNPRPEDGEGSCNPVTIDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21205 - protein, 470 aa, Artificial Sequence; identical to SEQ ID NO: 18930
  neuraminidase__InfluenzaA__AET84176

SEQ ID NO: 21206 - protein, 470 aa, Artificial Sequence
  neuraminidase__InfluenzaA__AET84187
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMDWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPKDGEGSCNPVTIDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21207 - protein, 470 aa, Artificial Sequence
  neuraminidase__InfluenzaA__AET84198
MNPNQKIITIGSISIAIGIISLMLQIGNIISIWASHSIQTGSQNNTGICNQRIITYENSTWVNHTYVNINNTNVVAGEDKTSMTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21208 - protein, 470 aa, Artificial Sequence
  neuraminidase__InfluenzaA__AET84209
MNPNQKIITIGSISIAIGIISLMLQIGNIISIWASHSIQTGSQNNTGICNQRIITYENSTWVNHTYVNINNTKVVAGEDKTSVTLAGNSSLCSISGWAINTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21209 - protein, 470 aa, Artificial Sequence
  neuraminidase__InfluenzaA__AET84231
MNPNQKIITIGSISIAIGIISLMLQIGSIISIWASHSIHTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKASSYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21210 - protein, 470 aa, Artificial Sequence; identical to SEQ ID NO: 17461
  neuraminidase__InfluenzaA__AET84242

SEQ ID NO: 21211 - protein, 470 aa, Artificial Sequence
  neuraminidase__InfluenzaA__AET84253
MNPNQKIITIGSISIAIGIISLMLQIGSIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21212 - protein, 470 aa, Artificial Sequence
  neuraminidase__InfluenzaA__AET84264
MNPNQKIITIGSISIAIGIISLMFQIGSIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21213 - protein, 470 aa, Artificial Sequence
  neuraminidase__InfluenzaA__AET84275
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21214 - protein, 470 aa, Artificial Sequence; identical to SEQ ID NO: 17461
  neuraminidase__InfluenzaA__AET84286

SEQ ID NO: 21215 - protein, 470 aa, Artificial Sequence
  neuraminidase__InfluenzaA__AET84297
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTTNWSWPDGAELPFTIDK

SEQ ID NO: 21216 - protein, 470 aa, Artificial Sequence
  neuraminidase__InfluenzaA__AET84308
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTTNWSWPDGAELPFTIDK

SEQ ID NO: 21217 - protein, 470 aa, Artificial Sequence
  neuraminidase__InfluenzaA__AET84319
MNPNQKIITIGSISIAIGIISLMLQIGNIISIWASHSIQTGSQNNTGICNQRIITYENSTWVNHTYVNINNTNVVAGEDKTSMTLAGNSSLCSISGWAIYTKDNSIRIGSKGDVFVIREPFISCSHLECRTFFLTQGALLNDKHSNRTVKDRSPYRALMSCPLGEAPSPYNSKFESVAWSASACHDGMGWLTIGISGPDNGAVAVLKYNGIITETIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21218 - protein, 470 aa, Artificial Sequence
  neuraminidase__InfluenzaA__AET84330
MNPNQRIITIGSISIAIGIISLMLQIGNIISIWASHSIQIGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21219 - protein, 470 aa, Artificial Sequence
  neuraminidase__InfluenzaA__AET84341
MNPNQRIITIGSISIAIGIISLMLQIGNIISIWASHSIQIGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 21220 - protein, 470 aa, Artificial Sequence
  neuraminidase__InfluenzaA__AET84363
MNPNQRIITIGSISIAIGIISLMLQIGNIISIWASHSIQTGSQNNTGICNQRIITYENSTWVNHTYVNINNTNVVAGEDKTSMTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21221 - protein, 470 aa, Artificial Sequence
  neuraminidase__InfluenzaA__AET84374
MNPNQRIITIGSISIAIGIISLMLQIGNIISIWASHSIQIGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITETIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21222 - protein, 470 aa, Artificial Sequence
  neuraminidase__InfluenzaA__AET84396
MNPNQRIITIGSISIAIGIISLMLQIGNIISIWASHSIQTGSQNNTGICNQRIITYENSTWVNHTYVNINNTNVVAGEDKTSMTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITETIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21223 - protein, 470 aa, Artificial Sequence
  neuraminidase__InfluenzaA__AET84407
MNPNQRIITIGSISIAIGIISLMLQIGNIISIWASHSIQIGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21224 - protein, 470 aa, Artificial Sequence
  neuraminidase__InfluenzaA__AET84418
MNPNQRIIAIGSISIAIGIISLMLQIGNIISIWASHSIQIGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTAKDRSPYRALMSCPLGEAPSPYNSKFESVAWSASACHDGMGWLTIGISGPDNGAVAVLKYNGIITETIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21225 - protein, 470 aa, Artificial Sequence
  neuraminidase__InfluenzaA__AET84429
MNPNQKIITIGSISIAIGIISLMLQIGNIISIWASHSIQTGSQNNTGICNQRIITYENSTWVNHTYVSINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQDLDYQIGYICSGVFGDNPRPKDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21226 - protein, 470 aa, Artificial Sequence
  neuraminidase__InfluenzaA__AET84440
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21227 - protein, 470 aa, Artificial Sequence
  neuraminidase__InfluenzaA__AET84451
MNPNQKIITIGSISIAIGIISLILQIGNIISIWASHSIQTGSQNHTGICNQRIITYENSTWVNNTYVNINNTNVVAEKDKTSVTLAGNSSLCSISGWAIYTKDNSIRIGSKGDVFVIREPFISCSHLECRTFFLTKGALLNDKHSNGTVTDRSPYRALMSCPLGEAPSPYNSRFESVAWSASACHDGMGWLTIGISGPDNGAVAVLKYNGIITETIKSWKKRILRTQESECVCMNGSCFTIMTDGPSNGAASYKIFKIEKGKVTKTIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSGTANWSWPDGAELPFTIDK

SEQ ID NO: 21228 - protein, 469 aa, Artificial Sequence; identical to SEQ ID NO: 16738
  neuraminidase__InfluenzaA__AEV53421

SEQ ID NO: 21229 - protein, 469 aa, Artificial Sequence; identical to SEQ ID NO: 16738
  neuraminidase__InfluenzaA__AEV53423

SEQ ID NO: 21230 - protein, 469 aa, Artificial Sequence; identical to SEQ ID NO: 18200
  neuraminidase__InfluenzaA__AEV53425

SEQ ID NO: 21231 - protein, 469 aa, Artificial Sequence; identical to SEQ ID NO: 16738
  neuraminidase__InfluenzaA__AEV53427

SEQ ID NO: 21232 - protein, 469 aa, Artificial Sequence; identical to SEQ ID NO: 18200
  neuraminidase__InfluenzaA__AEV53429

SEQ ID NO: 21233 - protein, 469 aa, Artificial Sequence
  neuraminidase__InfluenzaA__AEV53431
MNPNQKIITIGSVCMTIGMANLILQIGNIISIWISHSIQLGNQNQIETCNQSVITYENNTWVNQTYVNISNTNFAAGQSVVPVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSGTVGWSWPDGAELPFTIDK

SEQ ID NO: 21234 - protein, 469 aa, Artificial Sequence; identical to SEQ ID NO: 16738
  neuraminidase__InfluenzaA__AEV53435

SEQ ID NO: 21235 - protein, 469 aa, Artificial Sequence
  neuraminidase__InfluenzaA__AEV53437
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNTLRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21236 - protein, 469 aa, Artificial Sequence; identical to SEQ ID NO: 16738
  neuraminidase__InfluenzaA__AEV53439

SEQ ID NO: 21237 - protein, 469 aa, Artificial Sequence; identical to SEQ ID NO: 16738
  neuraminidase__InfluenzaA__AEV53441

SEQ ID NO: 21238 - protein, 469 aa, Artificial Sequence; identical to SEQ ID NO: 16738
  neuraminidase__InfluenzaA__AEV53443

SEQ ID NO: 21239 - protein, 469 aa, Artificial Sequence
  neuraminidase__InfluenzaA__AEV53445
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDHNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21240 - protein, 469 aa, Artificial Sequence; identical to SEQ ID NO: 16738
  neuraminidase__InfluenzaA__AEV53447

SEQ ID NO: 21241 - protein, 469 aa, Artificial Sequence; identical to SEQ ID NO: 18640
  neuraminidase__InfluenzaA__AEV53449

SEQ ID NO: 21242 - protein, 469 aa, Artificial Sequence
  neuraminidase__InfluenzaA__AEV53451
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFKIEKGKIVKSVEMNAPDYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21243 - protein, 469 aa, Artificial Sequence; identical to SEQ ID NO: 16738
  neuraminidase__InfluenzaA__AEV53453

SEQ ID NO: 21244 - protein, 469 aa, Artificial Sequence
  neuraminidase__InfluenzaA__AEV53455
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTETDNNFSIKQDIVGINEWSGYSGSFVQHPELTGLNCIRPCFWVELIRGRPKENTIWTSGSSISFCGVNSDTVGWSWPDGAELPFTIDK

SEQ ID NO: 21245 - protein, 469 aa, Artificial Sequence
  neuraminidase__InfluenzaA__AEV53457
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRVEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21246 - protein, 469 aa, Artificial Sequence
  neuraminidase__InfluenzaA__AEV53459
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVITDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTETDNNFSIKQDIVGINEWSGYSGSFVQHPELTGLNCIRPCFWVELIRGRPKENTIWTSGSSISFCGVNSDTVGWSWPDGAELPFTIDK

SEQ ID NO: 21247 - protein, 469 aa, Artificial Sequence; identical to SEQ ID NO: 16738
  neuraminidase__InfluenzaA__AEV53461

SEQ ID NO: 21248 - protein, 469 aa, Artificial Sequence
  neuraminidase__InfluenzaA__AEV53463
MNPNQKIITIGSVCMTIGMANLILQIGNIISIWISHSIQLENQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACINGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21249 - protein, 469 aa, Artificial Sequence
  neuraminidase__InfluenzaA__AEV53465
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDRQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSYKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21250 - protein, 469 aa, Artificial Sequence; identical to SEQ ID NO: 18539
  neuraminidase__InfluenzaA__AEV53467

SEQ ID NO: 21251 - protein, 469 aa, Artificial Sequence; identical to SEQ ID NO: 18539
  neuraminidase__InfluenzaA__AEV53469

SEQ ID NO: 21252 - protein, 469 aa, Artificial Sequence; identical to SEQ ID NO: 16738
  neuraminidase__InfluenzaA__AEV53471

SEQ ID NO: 21253 - protein, 469 aa, Artificial Sequence; identical to SEQ ID NO: 16738
  neuraminidase__InfluenzaA__AEV53473

SEQ ID NO: 21254 - protein, 469 aa, Artificial Sequence; identical to SEQ ID NO: 16738
  neuraminidase__InfluenzaA__AEV53475

SEQ ID NO: 21255 - protein, 469 aa, Artificial Sequence; identical to SEQ ID NO: 16738
  neuraminidase__InfluenzaA__AEV53477

SEQ ID NO: 21256 - protein, 469 aa, Artificial Sequence; identical to SEQ ID NO: 16738
  neuraminidase__InfluenzaA__AEV53479

SEQ ID NO: 21257 - protein, 469 aa, Artificial Sequence; identical to SEQ ID NO: 16738
  neuraminidase__InfluenzaA__AEV53481

SEQ ID NO: 21258 - protein, 469 aa, Artificial Sequence; identical to SEQ ID NO: 16738
  neuraminidase__InfluenzaA__AEV53483

SEQ ID NO: 21259 - protein, 469 aa, Artificial Sequence
  neuraminidase__InfluenzaA__AEV53485
MNPNQKIITIGSVCMTIGMANLILQIGNIISIWVSHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21260 - protein, 469 aa, Artificial Sequence; identical to SEQ ID NO: 18539
  neuraminidase__InfluenzaA__AEV53487

SEQ ID NO: 21261 - protein, 469 aa, Artificial Sequence; identical to SEQ ID NO: 17756
  neuraminidase__InfluenzaA__AEV53489

SEQ ID NO: 21262 - protein, 469 aa, Artificial Sequence
  neuraminidase__InfluenzaA__AEV53491
MNPNQKIITIGLVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21263 - protein, 469 aa, Artificial Sequence; identical to SEQ ID NO: 16738
  neuraminidase__InfluenzaA__AEV53493

SEQ ID NO: 21264 - protein, 469 aa, Artificial Sequence; identical to SEQ ID NO: 18200
  neuraminidase__InfluenzaA__AEV53495

SEQ ID NO: 21265 - protein, 469 aa, Artificial Sequence
  neuraminidase__InfluenzaA__AEV53497
MNPNQKIITIGSVCMTIGMANLILQIGNIISIWISHSIQLENQNQIETCNQSVITYENNTWVNQTYVNISNTNFAAGQSVVSVNLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21266 - protein, 469 aa, Artificial Sequence; identical to SEQ ID NO: 17756
  neuraminidase__InfluenzaA__AEV53499

SEQ ID NO: 21267 - protein, 469 aa, Artificial Sequence; identical to SEQ ID NO: 16738
  neuraminidase__InfluenzaA__AEV53501

SEQ ID NO: 21268 - protein, 469 aa, Artificial Sequence; identical to SEQ ID NO: 16738
  neuraminidase__InfluenzaA__AEV53503

SEQ ID NO: 21269 - protein, 469 aa, Artificial Sequence; identical to SEQ ID NO: 16738
  neuraminidase__InfluenzaA__AEV53505

SEQ ID NO: 21270 - protein, 469 aa, Artificial Sequence; identical to SEQ ID NO: 16738
  neuraminidase__InfluenzaA__AEV53507

SEQ ID NO: 21271 - protein, 469 aa, Artificial Sequence; identical to SEQ ID NO: 16738
  neuraminidase__InfluenzaA__AEV53509

SEQ ID NO: 21272 - protein, 469 aa, Artificial Sequence; identical to SEQ ID NO: 18200
  neuraminidase__InfluenzaA__AEV53511

SEQ ID NO: 21273 - protein, 469 aa, Artificial Sequence; identical to SEQ ID NO: 18200
  neuraminidase__InfluenzaA__AEV53513

SEQ ID NO: 21274 - protein, 469 aa, Artificial Sequence; identical to SEQ ID NO: 18200
  neuraminidase__InfluenzaA__AEV53515

SEQ ID NO: 21275 - protein, 469 aa, Artificial Sequence
  neuraminidase__InfluenzaA__AEV53517
MNPNQRIITIGSVCMTIGMANLILQIGNIISIWVSHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21276 - protein, 469 aa, Artificial Sequence; identical to SEQ ID NO: 16738
  neuraminidase__InfluenzaA__AEV53519

SEQ ID NO: 21277 - protein, 469 aa, Artificial Sequence; identical to SEQ ID NO: 18200
  neuraminidase__InfluenzaA__AEV53521

SEQ ID NO: 21278 - protein, 469 aa, Artificial Sequence; identical to SEQ ID NO: 18026
  neuraminidase__InfluenzaA__AEV53523

SEQ ID NO: 21279 - protein, 469 aa, Artificial Sequence; identical to SEQ ID NO: 17092
  neuraminidase__InfluenzaA__AEV53525

SEQ ID NO: 21280 - protein, 469 aa, Artificial Sequence; identical to SEQ ID NO: 16738
  neuraminidase__InfluenzaA__AEV53527

SEQ ID NO: 21281 - protein, 469 aa, Artificial Sequence
  neuraminidase__InfluenzaA__AEV53529
MNPNQKIITIGSVCMTIGMANLILQIGNIISIWISHSIQLENQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGIKEWSGYSGSFVQHPELTGLDCIRPCFWVELIRGRPKENTIWTSGSSISFCGVNSDTVGWSWPDGAELPFTIDK

SEQ ID NO: 21282 - protein, 469 aa, Artificial Sequence; identical to SEQ ID NO: 18200
  neuraminidase__InfluenzaA__AEV53531

SEQ ID NO: 21283 - protein, 469 aa, Artificial Sequence
  neuraminidase__InfluenzaA__AEV53533
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLNCIRPCFWVELIRGRPKENTIWTSGSSISFCGVNSDTVGWSWPDGAELPFTIDK

SEQ ID NO: 21284 - protein, 469 aa, Artificial Sequence; identical to SEQ ID NO: 16738
  neuraminidase__InfluenzaA__AEV53535

SEQ ID NO: 21285 - protein, 469 aa, Artificial Sequence; identical to SEQ ID NO: 21259
  neuraminidase__InfluenzaA__AEV53537

SEQ ID NO: 21286 - protein, 469 aa, Artificial Sequence; identical to SEQ ID NO: 16738
  neuraminidase__InfluenzaA__AEV53539

SEQ ID NO: 21287 - protein, 469 aa, Artificial Sequence; identical to SEQ ID NO: 20177
  neuraminidase__InfluenzaA__AEV53541

SEQ ID NO: 21288 - protein, 469 aa, Artificial Sequence; identical to SEQ ID NO: 20177
  neuraminidase__InfluenzaA__AEV53543

SEQ ID NO: 21289 - protein, 469 aa, Artificial Sequence; identical to SEQ ID NO: 18386
  neuraminidase__InfluenzaA__AEV53545

SEQ ID NO: 21290 - protein, 469 aa, Artificial Sequence; identical to SEQ ID NO: 20177
  neuraminidase__InfluenzaA__AEV53547

SEQ ID NO: 21291 - protein, 469 aa, Artificial Sequence; identical to SEQ ID NO: 20177
  neuraminidase__InfluenzaA__AEV53549

SEQ ID NO: 21292 - protein, 469 aa, Artificial Sequence; identical to SEQ ID NO: 20177
  neuraminidase__InfluenzaA__AEV53551

SEQ ID NO: 21293 - protein, 469 aa, Artificial Sequence; identical to SEQ ID NO: 20177
  neuraminidase__InfluenzaA__AEV53553

SEQ ID NO: 21294 - protein, 469 aa, Artificial Sequence; identical to SEQ ID NO: 21259
  neuraminidase__InfluenzaA__AEV53555

SEQ ID NO: 21295 - protein, 469 aa, Artificial Sequence; identical to SEQ ID NO: 17756
  neuraminidase__InfluenzaA__AEV53557

SEQ ID NO: 21296 - protein, 469 aa, Artificial Sequence; identical to SEQ ID NO: 16738
  neuraminidase__InfluenzaA__AEV53559

SEQ ID NO: 21297 - protein, 469 aa, Artificial Sequence; identical to SEQ ID NO: 16738
  neuraminidase__InfluenzaA__AEV53561

SEQ ID NO: 21298 - protein, 469 aa, Artificial Sequence; identical to SEQ ID NO: 18330
  neuraminidase__InfluenzaA__AEV53563

SEQ ID NO: 21299 - protein, 469 aa, Artificial Sequence
  neuraminidase__InfluenzaA__AEV53565
MNPNQKIITIGSVCMTIGMANLILQIGNIISIWISHSIQLGNQNQIETCNQSVITYENNTWVNQTYVNISNTNFAAGQSVVSVKLAGNSSLCPVNGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPLTIDK

SEQ ID NO: 21300 - protein, 469 aa, Artificial Sequence
  neuraminidase__InfluenzaA__AEV53567
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGAWIGRTKSISSRNGFEMIWDPNGWTETDNNFSIKQDIVGINEWSGYSGSFVQHPELTGLNCIRPCFWVELIRGRPKENTIWTSGSSISFCGVNSDTVGWSWPDGAELPFTIDK

SEQ ID NO: 21301 - protein, 469 aa, Artificial Sequence; identical to SEQ ID NO: 16738
  neuraminidase__InfluenzaA__AEV53569

SEQ ID NO: 21302 - protein, 469 aa, Artificial Sequence; identical to SEQ ID NO: 20177
  neuraminidase__InfluenzaA__AEV53571

SEQ ID NO: 21303 - protein, 469 aa, Artificial Sequence; identical to SEQ ID NO: 20177
  neuraminidase__InfluenzaA__AEV53573

SEQ ID NO: 21304 - protein, 469 aa, Artificial Sequence; identical to SEQ ID NO: 18539
  neuraminidase__InfluenzaA__AEV53575

SEQ ID NO: 21305 - protein, 469 aa, Artificial Sequence
  neuraminidase__InfluenzaA__AEV53577
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQQPELTGLDCIRPCFWVELIRGRPKENTIWTSGSSISFCGVNSDTVGWSWPDGAELPFTIDK

SEQ ID NO: 21306 - protein, 469 aa, Artificial Sequence; identical to SEQ ID NO: 21244
  neuraminidase__InfluenzaA__AEV53579

SEQ ID NO: 21307 - protein, 469 aa, Artificial Sequence; identical to SEQ ID NO: 18539
  neuraminidase__InfluenzaA__AEV53581

SEQ ID NO: 21308 - protein, 469 aa, Artificial Sequence; identical to SEQ ID NO: 18200
  neuraminidase__InfluenzaA__AEV53583

SEQ ID NO: 21309 - protein, 469 aa, Artificial Sequence; identical to SEQ ID NO: 18200
  neuraminidase__InfluenzaA__AEV53585

SEQ ID NO: 21310 - protein, 469 aa, Artificial Sequence
  neuraminidase__InfluenzaA__AEV76877
MNPNQKIITIGSVCMTIGMANLILQIGNIISIWISHSIQLGNQSQIETCNQSVITYENNTWVNQTYVNISTTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21311 - protein, 469 aa, Artificial Sequence; identical to SEQ ID NO: 16738
  neuraminidase__InfluenzaA__AEW10576

SEQ ID NO: 21312 - protein, 469 aa, Artificial Sequence; identical to SEQ ID NO: 16738
  neuraminidase__InfluenzaA__AEW10586

SEQ ID NO: 21313 - protein, 469 aa, Artificial Sequence; identical to SEQ ID NO: 16738
  neuraminidase__InfluenzaA__AEW10596

SEQ ID NO: 21314 - protein, 469 aa, Artificial Sequence; identical to SEQ ID NO: 16738
  neuraminidase__InfluenzaA__AEW10606

SEQ ID NO: 21315 - protein, 469 aa, Artificial Sequence; identical to SEQ ID NO: 17625
  neuraminidase__InfluenzaA__AEW10616

SEQ ID NO: 21316 - protein, 469 aa, Artificial Sequence
  neuraminidase__InfluenzaA__AEW10626
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAMAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21317 - protein, 469 aa, Artificial Sequence; identical to SEQ ID NO: 16738
  neuraminidase__InfluenzaA__AEW10636

SEQ ID NO: 21318 - protein, 469 aa, Artificial Sequence; identical to SEQ ID NO: 16728
  neuraminidase__InfluenzaA__AEW10646

SEQ ID NO: 21319 - protein, 469 aa, Artificial Sequence; identical to SEQ ID NO: 16738
  neuraminidase__InfluenzaA__AEW10656

SEQ ID NO: 21320 - protein, 469 aa, Artificial Sequence; identical to SEQ ID NO: 16738
  neuraminidase__InfluenzaA__AEW10666

SEQ ID NO: 21321 - protein, 469 aa, Artificial Sequence; identical to SEQ ID NO: 16738
  neuraminidase__InfluenzaA__AEW10676

SEQ ID NO: 21322 - protein, 469 aa, Artificial Sequence; identical to SEQ ID NO: 16738
  neuraminidase__InfluenzaA__AEW10686

SEQ ID NO: 21323 - protein, 469 aa, Artificial Sequence; identical to SEQ ID NO: 16738
  neuraminidase__InfluenzaA__AEW10696

SEQ ID NO: 21324 - protein, 469 aa, Artificial Sequence; identical to SEQ ID NO: 16738
  neuraminidase__InfluenzaA__AEW10706

SEQ ID NO: 21325 - protein, 469 aa, Artificial Sequence; identical to SEQ ID NO: 16728
  neuraminidase__InfluenzaA__AEW10716

SEQ ID NO: 21326 - protein, 469 aa, Artificial Sequence; identical to SEQ ID NO: 16738
  neuraminidase__InfluenzaA__AEW10726

SEQ ID NO: 21327 - protein, 469 aa, Artificial Sequence; identical to SEQ ID NO: 16738
  neuraminidase__InfluenzaA__AEW10736

SEQ ID NO: 21328 - protein, 469 aa, Artificial Sequence; identical to SEQ ID NO: 16728
  neuraminidase__InfluenzaA__AEW10746

SEQ ID NO: 21329 - protein, 469 aa, Artificial Sequence; identical to SEQ ID NO: 16728
  neuraminidase__InfluenzaA__AEW10756

SEQ ID NO: 21330 - protein, 469 aa, Artificial Sequence; identical to SEQ ID NO: 16728
  neuraminidase__InfluenzaA__AEW10766

SEQ ID NO: 21331 - protein, 469 aa, Artificial Sequence; identical to SEQ ID NO: 16728
  neuraminidase__InfluenzaA__AEW10776

SEQ ID NO: 21332 - protein, 469 aa, Artificial Sequence; identical to SEQ ID NO: 16728
  neuraminidase__InfluenzaA__AEW10786

SEQ ID NO: 21333 - protein, 469 aa, Artificial Sequence; identical to SEQ ID NO: 16728
  neuraminidase__InfluenzaA__AEW10796

SEQ ID NO: 21334 - protein, 469 aa, Artificial Sequence; identical to SEQ ID NO: 16728
  neuraminidase__InfluenzaA__AEW10806

SEQ ID NO: 21335 - protein, 469 aa, Artificial Sequence; identical to SEQ ID NO: 16728
  neuraminidase__InfluenzaA__AEW10816

SEQ ID NO: 21336 - protein, 469 aa, Artificial Sequence; identical to SEQ ID NO: 16738
  neuraminidase__InfluenzaA__AEW10826

SEQ ID NO: 21337 - protein, 469 aa, Artificial Sequence; identical to SEQ ID NO: 16728
  neuraminidase__InfluenzaA__AEW10836

SEQ ID NO: 21338 - protein, 469 aa, Artificial Sequence; identical to SEQ ID NO: 16728
  neuraminidase__InfluenzaA__AEW10846

SEQ ID NO: 21339 - protein, 469 aa, Artificial Sequence; identical to SEQ ID NO: 16728
  neuraminidase__InfluenzaA__AEW10856

SEQ ID NO: 21340 - protein, 469 aa, Artificial Sequence; identical to SEQ ID NO: 16728
  neuraminidase__InfluenzaA__AEW10866

SEQ ID NO: 21341 - protein, 469 aa, Artificial Sequence; identical to SEQ ID NO: 16728
  neuraminidase__InfluenzaA__AEW10876

SEQ ID NO: 21342 - protein, 469 aa, Artificial Sequence; identical to SEQ ID NO: 16728
  neuraminidase__InfluenzaA__AEW10886

SEQ ID NO: 21343 - protein, 469 aa, Artificial Sequence; identical to SEQ ID NO: 16728
  neuraminidase__InfluenzaA__AEW10896

SEQ ID NO: 21344 - protein, 469 aa, Artificial Sequence; identical to SEQ ID NO: 16728
  neuraminidase__InfluenzaA__AEW10906

SEQ ID NO: 21345 - protein, 469 aa, Artificial Sequence; identical to SEQ ID NO: 16728
  neuraminidase__InfluenzaA__AEW10916

SEQ ID NO: 21346 - protein, 469 aa, Artificial Sequence
  neuraminidase__InfluenzaA__AEW10926
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFIIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21347 - protein, 469 aa, Artificial Sequence; identical to SEQ ID NO: 16728
  neuraminidase__InfluenzaA__AEW10936

SEQ ID NO: 21348 - protein, 469 aa, Artificial Sequence; identical to SEQ ID NO: 16728
  neuraminidase__InfluenzaA__AEW10946

SEQ ID NO: 21349 - protein, 469 aa, Artificial Sequence; identical to SEQ ID NO: 16738
  neuraminidase__InfluenzaA__AEW10956

SEQ ID NO: 21350 - protein, 469 aa, Artificial Sequence; identical to SEQ ID NO: 16738
  neuraminidase__InfluenzaA__AEW10966

SEQ ID NO: 21351 - protein, 469 aa, Artificial Sequence; identical to SEQ ID NO: 16728
  neuraminidase__InfluenzaA__AEW10976

SEQ ID NO: 21352 - protein, 469 aa, Artificial Sequence; identical to SEQ ID NO: 16738
  neuraminidase__InfluenzaA__AEW10986

SEQ ID NO: 21353 - protein, 469 aa, Artificial Sequence; identical to SEQ ID NO: 16738
  neuraminidase__InfluenzaA__AEW10996

SEQ ID NO: 21354 - protein, 469 aa, Artificial Sequence; identical to SEQ ID NO: 16738
  neuraminidase__InfluenzaA__AEW11006

SEQ ID NO: 21355 - protein, 469 aa, Artificial Sequence; identical to SEQ ID NO: 16738
  neuraminidase__InfluenzaA__AEW11016

SEQ ID NO: 21356 - protein, 469 aa, Artificial Sequence; identical to SEQ ID NO: 16738
  neuraminidase__InfluenzaA__AEW11026

SEQ ID NO: 21357 - protein, 469 aa, Artificial Sequence; identical to SEQ ID NO: 16738
  neuraminidase__InfluenzaA__AEW11036

SEQ ID NO: 21358 - protein, 469 aa, Artificial Sequence; identical to SEQ ID NO: 16728
  neuraminidase__InfluenzaA__AEW11046

SEQ ID NO: 21359 - protein, 469 aa, Artificial Sequence; identical to SEQ ID NO: 16738
  neuraminidase__InfluenzaA__AEW11056

SEQ ID NO: 21360 - protein, 469 aa, Artificial Sequence; identical to SEQ ID NO: 17542
  neuraminidase__InfluenzaA__AEW11066

SEQ ID NO: 21361 - protein, 469 aa, Artificial Sequence; identical to SEQ ID NO: 17542
  neuraminidase__InfluenzaA__AEW11076

SEQ ID NO: 21362 - protein, 469 aa, Artificial Sequence; identical to SEQ ID NO: 17542
  neuraminidase__InfluenzaA__AEW11086

SEQ ID NO: 21363 - protein, 469 aa, Artificial Sequence; identical to SEQ ID NO: 17542
  neuraminidase__InfluenzaA__AEW11096

SEQ ID NO: 21364 - protein, 469 aa, Artificial Sequence; identical to SEQ ID NO: 17542
  neuraminidase__InfluenzaA__AEW11106

SEQ ID NO: 21365 - protein, 469 aa, Artificial Sequence; identical to SEQ ID NO: 16738
  neuraminidase__InfluenzaA__AEW11116

SEQ ID NO: 21366 - protein, 469 aa, Artificial Sequence; identical to SEQ ID NO: 17542
  neuraminidase__InfluenzaA__AEW11126

SEQ ID NO: 21367 - protein, 469 aa, Artificial Sequence; identical to SEQ ID NO: 17446
  neuraminidase__InfluenzaA__AEW11136

SEQ ID NO: 21368 - protein, 469 aa, Artificial Sequence; identical to SEQ ID NO: 16738
  neuraminidase__InfluenzaA__AEW11146

SEQ ID NO: 21369 - protein, 469 aa, Artificial Sequence; identical to SEQ ID NO: 16738
  neuraminidase__InfluenzaA__AEW11156

SEQ ID NO: 21370 - protein, 469 aa, Artificial Sequence; identical to SEQ ID NO: 17542
  neuraminidase__InfluenzaA__AEW11166

SEQ ID NO: 21371 - protein, 469 aa, Artificial Sequence; identical to SEQ ID NO: 17542
  neuraminidase__InfluenzaA__AEW11176

SEQ ID NO: 21372 - protein, 469 aa, Artificial Sequence; identical to SEQ ID NO: 16738
  neuraminidase__InfluenzaA__AEW11186

SEQ ID NO: 21373 - protein, 469 aa, Artificial Sequence; identical to SEQ ID NO: 17542
  neuraminidase__InfluenzaA__AEW11196

SEQ ID NO: 21374 - protein, 469 aa, Artificial Sequence; identical to SEQ ID NO: 16738
  neuraminidase__InfluenzaA__AEW11206

SEQ ID NO: 21375 - protein, 469 aa, Artificial Sequence; identical to SEQ ID NO: 16738
  neuraminidase__InfluenzaA__AEW11216

SEQ ID NO: 21376 - protein, 469 aa, Artificial Sequence; identical to SEQ ID NO: 17446
  neuraminidase__InfluenzaA__AEW11226

SEQ ID NO: 21377 - protein, 469 aa, Artificial Sequence; identical to SEQ ID NO: 16738
  neuraminidase__InfluenzaA__AEW11236

SEQ ID NO: 21378 - protein, 469 aa, Artificial Sequence; identical to SEQ ID NO: 16738
  neuraminidase__InfluenzaA__AEW11246

SEQ ID NO: 21379 - protein, 469 aa, Artificial Sequence; identical to SEQ ID NO: 17542
  neuraminidase__InfluenzaA__AEW11255

SEQ ID NO: 21380 - protein, 469 aa, Artificial Sequence; identical to SEQ ID NO: 17542
  neuraminidase__InfluenzaA__AEW11265

SEQ ID NO: 21381 - protein, 469 aa, Artificial Sequence; identical to SEQ ID NO: 16738
  neuraminidase__InfluenzaA__AEW11275

SEQ ID NO: 21382 - protein, 469 aa, Artificial Sequence
  neuraminidase__InfluenzaA__AEW11285
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQNPELTGLDCIRPCFWVELIRGRPKENTIWTSGSSISFCGVNSDTVGWSWPDGAELPFTIDK

SEQ ID NO: 21383 - protein, 469 aa, Artificial Sequence; identical to SEQ ID NO: 17542
  neuraminidase__InfluenzaA__AEW11295

SEQ ID NO: 21384 - protein, 469 aa, Artificial Sequence; identical to SEQ ID NO: 16738
  neuraminidase__InfluenzaA__AEW11305

SEQ ID NO: 21385 - protein, 469 aa, Artificial Sequence; identical to SEQ ID NO: 17542
  neuraminidase__InfluenzaA__AEW11315

SEQ ID NO: 21386 - protein, 469 aa, Artificial Sequence; identical to SEQ ID NO: 16738
  neuraminidase__InfluenzaA__AEW11325

SEQ ID NO: 21387 - protein, 469 aa, Artificial Sequence; identical to SEQ ID NO: 16738
  neuraminidase__InfluenzaA__AEW25299

SEQ ID NO: 21388 - protein, 469 aa, Artificial Sequence; identical to SEQ ID NO: 16738
  neuraminidase__InfluenzaA__AEW25308

SEQ ID NO: 21389 - protein, 469 aa, Artificial Sequence; identical to SEQ ID NO: 17811
  neuraminidase__InfluenzaA__AEW25317

SEQ ID NO: 21390 - protein, 469 aa, Artificial Sequence; identical to SEQ ID NO: 16738
  neuraminidase__InfluenzaA__AEW25324

SEQ ID NO: 21391 - protein, 469 aa, Artificial Sequence
  neuraminidase__InfluenzaA__AEW25327
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPPPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHCEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21392 - protein, 469 aa, Artificial Sequence
  neuraminidase__InfluenzaA__AEW25333
MNPNQKIITIGSVCMTIGMANLILQIGNIISIWISHSIQLGNQNQIETCNQSVITYENNTWVNHTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWVGRTKSISSRNGFEMIWDPNGWTGTDNNFSIKQDIVGINEWSGYSGSFVQHPELTGLDCIRHCFWVELIRGRPKENTIWTSGSSISFCGVNSDTVGWSWPDGAELPFTIDK

SEQ ID NO: 21393 - protein, 469 aa, Artificial Sequence
  neuraminidase__InfluenzaA__AEW25338
MNPNQKIITIGSVCMAIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYIRSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21394 - protein, 469 aa, Artificial Sequence
  neuraminidase__InfluenzaA__AEW25343
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRSESVAWSASACHDGINWLTIGISGPDNGAVAVLKYNGIITDTIKSWRNNILRTQESVCACVNGSCFTVMTDGPSDGQASYKIFRIEKGKIVKSVEMNAPNYHYEECSCYPDSSEITCVCRDNWHGSNRPWVSFNQNLEYQIGYICSGIFGDSPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21395 - protein, 469 aa, Artificial Sequence
  neuraminidase__InfluenzaA__AEW25351
MNPNQKIITIGSVCMTIGMANLILQIGNIISIWISHSIQLGNQNQIETCNQSVITYENNTWVNHTYVNISNTNFAAGQSVVSVKLAGNSSLCPVSGWAIYSKDNSIRIGSKGDVFVIREPFISCSPLECRTFFLTQGALLNDKHSNGTINDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGTFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21396 - protein, 469 aa, Artificial Sequence
  neuraminidase__InfluenzaA__AEW25358
MNPNQKIITIGSVCMTIGMANLILQIGNIISIWVSHSIQLGNQNQIETCNQSVITYENNTWVNQTYVNISNTNFAAGQSVVSVKLAGNSSLCPVSGWAIYSKDNSIRIGSKGDVFVIREPFTSCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIVK

SEQ ID NO: 21397 - protein, 469 aa, Artificial Sequence; identical to SEQ ID NO: 16738
  neuraminidase__InfluenzaA__AEW25361

SEQ ID NO: 21398 - protein, 469 aa, Artificial Sequence
  neuraminidase__InfluenzaA__AEW25379
MNPNQKIITIGSVCMTIGMANLILQIGNIISIWTSHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEVTCVCRDNWHGSNRPWVSFNQNLEYQIGYICSGIFGDNPRPNDKTGSCGPVSSDGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21399 - protein, 469 aa, Artificial Sequence
  neuraminidase__InfluenzaA__AEW25387
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVDGSCFTVMTDGPSDGQASYKIFRIEKGKIVKSVEMNAPNYHYEECSCYPDSSEITCVCRDNWHGSNRPWVSFNQNLEYQIGYICSGIFEDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21400 - protein, 469 aa, Artificial Sequence
  neuraminidase__InfluenzaA__AEW25392
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKHDIVGINEWSGYSGSFVQHPELTGLDCIRPCFWVELIRGRPKENTIWTSGSSISFCGVNSDTVGWSWPDGAELPFTIDK

SEQ ID NO: 21401 - protein, 469 aa, Artificial Sequence
  neuraminidase__InfluenzaA__AEW25397
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFEPVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDSPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDNVGWSWPDGAELPFTIDK

SEQ ID NO: 21402 - protein, 469 aa, Artificial Sequence; identical to SEQ ID NO: 16738
  neuraminidase__InfluenzaA__AEW25402

SEQ ID NO: 21403 - protein, 469 aa, Artificial Sequence; identical to SEQ ID NO: 16738
  neuraminidase__InfluenzaA__AEW25407

SEQ ID NO: 21404 - protein, 469 aa, Artificial Sequence
  neuraminidase__InfluenzaA__AEW25418
MNPNQKIITIGSVCMTIGMANLILQIGNIISIWISHSIQLGNQNQIETCNQSVITYENNTWVNHTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIGKGKIVKSVEMNAPNYHYEECSCYPDSSEITCVCRDNWHGSNRPWVSFNQNLEYQIGYICSGIFGDNPRPNDKTGSCGPVSSNGENGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWFWPDGAELPFTIDK

SEQ ID NO: 21405 - protein, 469 aa, Artificial Sequence
  neuraminidase__InfluenzaA__AEW25423
MNPNQKIITIGSVCMTIGMANLILQIGNIISIWISNSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21406 - protein, 469 aa, Artificial Sequence; identical to SEQ ID NO: 16738
  neuraminidase__InfluenzaA__AEW25426

SEQ ID NO: 21407 - protein, 469 aa, Artificial Sequence
  neuraminidase__InfluenzaA__AEW25432
MNPNQKIITIGSVCMTIGMANLILQIGNIISIWTSHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNSSIKQDIVGINEWSGYSGSFVQHPELTGLDCIRPCFWVELIRGRPKENTIWTSGSSISFCGINSDAVGWSWPDGAELPFTIDK

SEQ ID NO: 21408 - protein, 469 aa, Artificial Sequence
  neuraminidase__InfluenzaA__AEW25436
MNPNQKIITIGSVCMTIGMANLILQIGNIISIWISHSIQLGNQNQIETCNQSIITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIVGTNEWSGYSGSFVQHPELTGLDCIRPCFWVELIRGRPKENTIWTSGSSISFCGVNSDTMGWSWPDGAELPFTIDK

SEQ ID NO: 21409 - protein, 469 aa, Artificial Sequence; identical to SEQ ID NO: 16738
  neuraminidase__InfluenzaA__AEW25440

SEQ ID NO: 21410 - protein, 469 aa, Artificial Sequence
  neuraminidase__InfluenzaA__AEW25448
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTTDK

SEQ ID NO: 21411 - protein, 469 aa, Artificial Sequence; identical to SEQ ID NO: 16738
  neuraminidase__InfluenzaA__AEW25456

SEQ ID NO: 21412 - protein, 469 aa, Artificial Sequence
  neuraminidase__InfluenzaA__AEW25464
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVELNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21413 - protein, 469 aa, Artificial Sequence
  neuraminidase__InfluenzaA__AEW25474
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPSTIDK

SEQ ID NO: 21414 - protein, 469 aa, Artificial Sequence
  neuraminidase__InfluenzaA__AEW25484
MNPNQKIITIGSVCMTIGMANLILQIGNIISIWISHSIQLGNQNQIETCNQSVITYENNTWINQTYVNISNTNFAAGQSVVSVKLAGNSSLCPVSGWAIYSKDNSIRIGSKGDVFVIREPFISCSHLECRTFFLTQGALLNDKHSNGTIKDRSPYRTLMSCPIGEVPSPYNSRFESVAWSASACHDGINWLTIGISGPDHGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21415 - protein, 469 aa, Artificial Sequence
  neuraminidase__InfluenzaA__AEW25494
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDSIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGTFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21416 - protein, 469 aa, Artificial Sequence
  neuraminidase__InfluenzaA__AEW25503
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGAWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21417 - protein, 469 aa, Artificial Sequence
  neuraminidase__InfluenzaA__AEW25511
MNPNQKIITIGSVCMTIGMANLILQIGNIISIWISHSIQLGNQNQIETCNQSVITYENNTWVNHTYVNISNTNFAAGQSVVSVKLAGNSSLCPVSGWAIYSKDNSIRIGSKGVVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21418 - protein, 469 aa, Artificial Sequence
  neuraminidase__InfluenzaA__AEW25530
MNPNQKIITIGSVCMTIGMANLILQIGNIISIWISHSIQLGNQNQIETCNQSVITYENNTWVNHTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRYNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGENGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21419 - protein, 469 aa, Artificial Sequence
  neuraminidase__InfluenzaA__AEW25537
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNHHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21420 - protein, 469 aa, Artificial Sequence; identical to SEQ ID NO: 16738
  neuraminidase__InfluenzaA__AEW25547

SEQ ID NO: 21421 - protein, 469 aa, Artificial Sequence; identical to SEQ ID NO: 16738
  neuraminidase__InfluenzaA__AEW25556

SEQ ID NO: 21422 - protein, 469 aa, Artificial Sequence; identical to SEQ ID NO: 16738
  neuraminidase__InfluenzaA__AEW25566

SEQ ID NO: 21423 - protein, 469 aa, Artificial Sequence
  neuraminidase__InfluenzaA__AEW25584
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQGIVGINEWSGYGGSFVQHPELTGLDCIRPCFWVELIRGRPKENTIWTSGSSISFCGVNSDTVGWSWPDGAELPFTIDK

SEQ ID NO: 21424 - protein, 469 aa, Artificial Sequence; identical to SEQ ID NO: 16738
  neuraminidase__InfluenzaA__AEW25592

SEQ ID NO: 21425 - protein, 469 aa, Artificial Sequence
  neuraminidase__InfluenzaA__AEW25602
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDKNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21426 - protein, 469 aa, Artificial Sequence
  neuraminidase__InfluenzaA__AEW25612
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDRQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21427 - protein, 469 aa, Artificial Sequence
  neuraminidase__InfluenzaA__AEW25622
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENSIWTSGSSISFCGVNSDTVGWSWPDGAELPFTIDK

SEQ ID NO: 21428 - protein, 469 aa, Artificial Sequence
  neuraminidase__InfluenzaA__AEW25631
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGASGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21429 - protein, 469 aa, Artificial Sequence; identical to SEQ ID NO: 16738
  neuraminidase__InfluenzaA__AEW25639

SEQ ID NO: 21430 - protein, 469 aa, Artificial Sequence
  neuraminidase__InfluenzaA__AEW25648
MNPNQKIITIGSVCMTIGMANLILQIGNIISIWISHSIQLGNQNQIETCNQSVITYENNTWVNHTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21431 - protein, 469 aa, Artificial Sequence
  neuraminidase__InfluenzaA__AEW25656
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFPIKQDIVGINEWSGYSGSFVQHPELTGLDCIRPCFWVELIRGRPKENTIWTSGSSISFCGVNSDTVGWSWPDGAELPFTIDK

SEQ ID NO: 21432 - protein, 469 aa, Artificial Sequence
  neuraminidase__InfluenzaA__AEW25664
MNPNQKIITIGSVCMTIGMANLILQIGNIISIWISHSIQLGNQNQIETCNQSVITYENNTWVNQTYVNISNTNFTAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTGGWSWPDGAELPFTIDK

SEQ ID NO: 21433 - protein, 469 aa, Artificial Sequence; identical to SEQ ID NO: 21427
  neuraminidase__InfluenzaA__AEW25671

SEQ ID NO: 21434 - protein, 469 aa, Artificial Sequence; identical to SEQ ID NO: 17915
  neuraminidase__InfluenzaA__AEW25680

SEQ ID NO: 21435 - protein, 469 aa, Artificial Sequence
  neuraminidase__InfluenzaA__AEW25689
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRVGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21436 - protein, 469 aa, Artificial Sequence; identical to SEQ ID NO: 21430
  neuraminidase__InfluenzaA__AEW25698

SEQ ID NO: 21437 - protein, 469 aa, Artificial Sequence; identical to SEQ ID NO: 16738
  neuraminidase__InfluenzaA__AEW25708

SEQ ID NO: 21438 - protein, 469 aa, Artificial Sequence; identical to SEQ ID NO: 16738
  neuraminidase__InfluenzaA__AEX09177

SEQ ID NO: 21439 - protein, 470 aa, Artificial Sequence
  neuraminidase__InfluenzaA__AEX33324
MNPNQKIITIGSISIAIGIISLMLQIGNIISIWASHSIQTGSQNHTGICNQRIITYENSTWVNHTYVTINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21440 - protein, 470 aa, Artificial Sequence
  neuraminidase__InfluenzaA__AEX33368
MNPNQKIITIGSISIAIGIISLMLQIGNIISIWASHSIQTGSQNHTGICNQRIITYENSTWVNHTYVNINNTNVVAGKDKTSVTLAGNSSLCAISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21441 - protein, 470 aa, Artificial Sequence
  neuraminidase__InfluenzaA__AEX33379
MNPNQKIITIGSISIAIGIISLMLQIGNIISIWASHSIQTGIQNHTGICNQRIITYENSTWVNHTYVTINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPRDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21442 - protein, 470 aa, Artificial Sequence; identical to SEQ ID NO: 21441
  neuraminidase__InfluenzaA__AEX33390

SEQ ID NO: 21443 - protein, 470 aa, Artificial Sequence; identical to SEQ ID NO: 21441
  neuraminidase__InfluenzaA__AEX33401

SEQ ID NO: 21444 - protein, 470 aa, Artificial Sequence; identical to SEQ ID NO: 21441
  neuraminidase__InfluenzaA__AEX33412

SEQ ID NO: 21445 - protein, 470 aa, Artificial Sequence; identical to SEQ ID NO: 21441
  neuraminidase__InfluenzaA__AEX33423

SEQ ID NO: 21446 - protein, 470 aa, Artificial Sequence; identical to SEQ ID NO: 21441
  neuraminidase__InfluenzaA__AEX33434

SEQ ID NO: 21447 - protein, 470 aa, Artificial Sequence; identical to SEQ ID NO: 21441
  neuraminidase__InfluenzaA__AEX33445

SEQ ID NO: 21448 - protein, 469 aa, Artificial Sequence
  neuraminidase__InfluenzaA__AEX33544
MNPNQKIITIGSFSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEKTEVWWTSNSIVVFCGTSGTYGTGSWPDGADINLMPI

SEQ ID NO: 21449 - protein, 469 aa, Artificial Sequence; identical to SEQ ID NO: 14714
  neuraminidase__InfluenzaA__AEX33555

SEQ ID NO: 21450 - protein, 469 aa, Artificial Sequence
  neuraminidase__InfluenzaA__AEX33610
MNPNQKIITIGSVSLTISTICFFMQIAILITTVTLHFKQYEFNPPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYNIVSSYVCSGLVGDTPRKNDSSSSSHCLDPNNEEGGHGVKGWAFDDGNDVWMGRTISEKLRSGYETFKVIGGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21451 - protein, 469 aa, Artificial Sequence
  neuraminidase__InfluenzaA__AEX33828
MNPNQKIITIGSVSLTISTICFFMQIAILITTVTLHFKQYEFNPPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21452 - protein, 469 aa, Artificial Sequence; identical to SEQ ID NO: 14712
  neuraminidase__InfluenzaA__AEX33839

SEQ ID NO: 21453 - protein, 470 aa, Artificial Sequence
  neuraminidase__InfluenzaA__AEX33861
MNPNQKIITIGSISIAIGTISLMLQVGNIISIWASHSIQTGSQNHTGICNQRIITYENSTWVNHTYVNINNTNVVAGKDKTSVALAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGQVTKSVELNAPNFHYEECSCYPDTGTVMCVCRDNWHGSNRPWVSFNQNLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 21454 - protein, 469 aa, Artificial Sequence
  neuraminidase__InfluenzaA__AEX33872
MNPNQKIITIGSVSLTISTICFFMQIAILITTVTLHFKQYEFNSPPNNQVMQCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLNPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21455 - protein, 469 aa, Artificial Sequence; identical to SEQ ID NO: 14712
  neuraminidase__InfluenzaA__AEX33883

SEQ ID NO: 21456 - protein, 469 aa, Artificial Sequence
  neuraminidase__InfluenzaA__AEX33894
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCIDGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21457 - protein, 470 aa, Artificial Sequence
  neuraminidase__InfluenzaA__AEX33916
MNPNQKIITIGSISIAIGIISLILQIGNIISIWASHSIQTGSQNHTGICNQRIITYENSTWVNNTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGAASYKIFKIEKGKVTKTIELNAPNFHYEECSCYPDTGTVMCVCRDNWHGSNRPWVSFNQNLDYQTGYICSGVFGDNPRPKDGEGSCNPMTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSGTANWSWPDGAELPFTIDK

SEQ ID NO: 21458 - protein, 470 aa, Artificial Sequence; identical to SEQ ID NO: 15869
  neuraminidase__InfluenzaA__AEX33927

SEQ ID NO: 21459 - protein, 470 aa, Artificial Sequence
  neuraminidase__InfluenzaA__AEX33938
MNPNQKIITIGSISIAIGIISLILQIGNIISIWASHSIQTGSQNHTGICNQRIITYENSTWVNNTYVNINNTNVVVEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGAASYKIFKIEKGKVTKTIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSGTTNWSWPDGAELPFTIDK

SEQ ID NO: 21460 - protein, 470 aa, Artificial Sequence
  neuraminidase__InfluenzaA__AEX33949
MNPNQKIITIGSISIAIGIISLILQIGNIISIWASHSIQTGSQNHTGICNQRIITYENSTWVNNTYVNINNTNVVVEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETVKSWKKRILRTQESECVCMNGSCFTIMTDGPSNGAASYKIFKIEKGKVTKTIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSGTANWSWPDGAELPFTIDK

SEQ ID NO: 21461 - protein, 469 aa, Artificial Sequence
  neuraminidase__InfluenzaA__AEX33971
MNPNQKIITIGSVSLTISTICFFMQIAILITTVTLHFKQYEFSSPPNNQVMLCEPAIIERNITETVYLTNTTTEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGIVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21462 - protein, 469 aa, Artificial Sequence
  neuraminidase__InfluenzaA__AEX33993
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 21463 - protein, 469 aa, Artificial Sequence; identical to SEQ ID NO: 16512
  neuraminidase__InfluenzaA__AEX34026

SEQ ID NO: 21464 - protein, 469 aa, Artificial Sequence
  neuraminidase__InfluenzaA__AEX34036
MNPNQKIITIGSVSLTISTICFFMQIAILITTVTLHFKQYEFSSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHGRTPYRTLLMNELGVPFHLGTKQVCIAWSSSSCHDGKAWLHVCVTGDDKNATASFIYNGRLVDSIVSWSKEILRTQESECVCINGTCAVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGDDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21465 - protein, 469 aa, Artificial Sequence
  neuraminidase__InfluenzaA__AEX34058
MNPNQKIITIGSVSLTISTICFFMQIAILITTVTLHFKQYEFSSPPNNQVMLCEPAIIERNITEIVYLTNTTIEKEICPKLTEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21466 - protein, 469 aa, Artificial Sequence
  neuraminidase__InfluenzaA__AEX34103
MNPNQKIITIGSVSLTISTICFFMQIAILITTVTLHFKQYEFSSPPNNQVMLCEPTIIERNITEIVYLTNTTIEKEVCPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGNAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETKVLWTSNSIVVFCGTSGTYGTGSWPDGADINLMPI

SEQ ID NO: 21467 - protein, 469 aa, Artificial Sequence
  neuraminidase__InfluenzaA__AEX34114
MNPNQKIITIGSVSLTISTICFFMQIAILITTVTLHFKQYEFSSPPNNQVMLCEPAIIERNITEIVYPTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21468 - protein, 469 aa, Artificial Sequence
  neuraminidase__InfluenzaA__AEX34137
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRGRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21469 - protein, 469 aa, Artificial Sequence
  neuraminidase__InfluenzaA__AEX34191
MNPNQKIITIGSVSLSISTICFFMQIAILITTVTLHFKQYEFNSSPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21470 - protein, 469 aa, Artificial Sequence
  neuraminidase__InfluenzaA__AEX34224
MNPNQKIITIGSVSLTISTICFFMQIAILITTVTLHFKQYEFSSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHGRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21471 - protein, 469 aa, Artificial Sequence
  neuraminidase__InfluenzaA__AEX34235
MNPNQKIITIGSVSLTISTICFFMQIAILITTVTLHFKQYEFSSPPNNQVMLCEPAIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKSDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21472 - protein, 469 aa, Artificial Sequence
  neuraminidase__InfluenzaA__AEX34246
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRGRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQVNRQVIVDRGNRSGYSGIFSVEGKSCINRCFYVELIRGRKEETEVLWTSNSIVVFCGTSGTYGTGSWPDGADINLMPI

SEQ ID NO: 21473 - protein, 469 aa, Artificial Sequence
  neuraminidase__InfluenzaA__AEX34257
MNPNQKIITIGSVSLTISTICFFMQIAILITTVTLHFKQYEFNSSPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21474 - protein, 469 aa, Artificial Sequence
  neuraminidase__InfluenzaA__AEX34268
MNPNKKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSKLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21475 - protein, 469 aa, Artificial Sequence
  neuraminidase__InfluenzaA__AEX34278
MNPNQKIITIGSVSLTISTICFFMQIAILITTVTLHFKQYEFSSPPNNQVMLCEPAIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEKGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21476 - protein, 470 aa, Artificial Sequence
  neuraminidase__InfluenzaA__AEX34310
MNPNQKIITIGSISIAIGIISLMLQIGNIISIWASHSIQTGTQNHTGICNQRIITYENSTWVNHTYVNINNTNVVAGKDKTPVTLVGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYKGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDREGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPGENTTIWTSGSSISFCGVNGDIANWSWPDGAELPFTIDK

SEQ ID NO: 21477 - protein, 470 aa, Artificial Sequence
  neuraminidase__InfluenzaA__AEX34321
MNPNQKIITIGSISIAIGIISLMLQIGNIISIWVSHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21478 - protein, 469 aa, Artificial Sequence; identical to SEQ ID NO: 16057
  neuraminidase__InfluenzaA__AEX34356

SEQ ID NO: 21479 - protein, 469 aa, Artificial Sequence
  neuraminidase__InfluenzaA__AEX34367
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAKHVEECSCYPRHPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21480 - protein, 469 aa, Artificial Sequence
  neuraminidase__InfluenzaA__AEX34378
MNPNQKIITIGSVSLTISTICFFMQIAILITTVTLHFKQYEFNSPPNNQVMLCEPTIIERNITEIVYLTNTTIEKEICPNLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAKHVEECSCYPRHPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21481 - protein, 469 aa, Artificial Sequence
  neuraminidase__InfluenzaA__AEX34400
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRGRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIKEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21482 - protein, 470 aa, Artificial Sequence
  neuraminidase__InfluenzaA__AEX34432
MNPNQKIITIGSISIAIGIISLILQIGNIISIWASHSIQTGSQNHTGICNQRIITYENSTWVNNTYVNINNTNVVVEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGTASYKIFKIEKGKVTKTIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSGTANWSWPDGAELPFTIDK

SEQ ID NO: 21483 - protein, 470 aa, Artificial Sequence; identical to SEQ ID NO: 21482
  neuraminidase__InfluenzaA__AEX34443

SEQ ID NO: 21484 - protein, 469 aa, Artificial Sequence; identical to SEQ ID NO: 16603
  neuraminidase__InfluenzaA__AEX34454

SEQ ID NO: 21485 - protein, 470 aa, Artificial Sequence
  neuraminidase__InfluenzaA__AEX34465
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGIKGFSYKYGNGVWIGRTKSNRLRKGFEMIWDPNGWTDTDSDFSVKQDVVAITDWSGYSGSFVQHPELTGLDCMRPCFWVELVRGLPRENTTIWTSGSSISFCGVNSDTANWSWPDGAELPFTIDK

SEQ ID NO: 21486 - protein, 470 aa, Artificial Sequence; identical to SEQ ID NO: 21439
  neuraminidase__InfluenzaA__AEX34476

SEQ ID NO: 21487 - protein, 470 aa, Artificial Sequence; identical to SEQ ID NO: 21441
  neuraminidase__InfluenzaA__AEX34487

SEQ ID NO: 21488 - protein, 470 aa, Artificial Sequence; identical to SEQ ID NO: 21441
  neuraminidase__InfluenzaA__AEX34498

SEQ ID NO: 21489 - protein, 470 aa, Artificial Sequence; identical to SEQ ID NO: 21441
  neuraminidase__InfluenzaA__AEX34509

SEQ ID NO: 21490 - protein, 470 aa, Artificial Sequence; identical to SEQ ID NO: 21441
  neuraminidase__InfluenzaA__AEX34520

SEQ ID NO: 21491 - protein, 470 aa, Artificial Sequence; identical to SEQ ID NO: 21441
  neuraminidase__InfluenzaA__AEX34531

SEQ ID NO: 21492 - protein, 470 aa, Artificial Sequence; identical to SEQ ID NO: 21441
  neuraminidase__InfluenzaA__AEX34542

SEQ ID NO: 21493 - protein, 470 aa, Artificial Sequence; identical to SEQ ID NO: 21441
  neuraminidase__InfluenzaA__AEX34553

SEQ ID NO: 21494 - protein, 470 aa, Artificial Sequence; identical to SEQ ID NO: 21441
  neuraminidase__InfluenzaA__AEX34564

SEQ ID NO: 21495 - protein, 470 aa, Artificial Sequence; identical to SEQ ID NO: 21441
  neuraminidase__InfluenzaA__AEX34575

SEQ ID NO: 21496 - protein, 470 aa, Artificial Sequence; identical to SEQ ID NO: 21441
  neuraminidase__InfluenzaA__AEX34586

SEQ ID NO: 21497 - protein, 470 aa, Artificial Sequence; identical to SEQ ID NO: 21441
  neuraminidase__InfluenzaA__AEX34597

SEQ ID NO: 21498 - protein, 470 aa, Artificial Sequence; identical to SEQ ID NO: 21441
  neuraminidase__InfluenzaA__AEX34608

SEQ ID NO: 21499 - protein, 470 aa, Artificial Sequence; identical to SEQ ID NO: 21441
  neuraminidase__InfluenzaA__AEX34619

SEQ ID NO: 21500 - protein, 470 aa, Artificial Sequence; identical to SEQ ID NO: 21441
  neuraminidase__InfluenzaA__AEX34630

SEQ ID NO: 21501 - protein, 470 aa, Artificial Sequence; identical to SEQ ID NO: 21441
  neuraminidase__InfluenzaA__AEX34641

SEQ ID NO: 21502 - protein, 470 aa, Artificial Sequence
  neuraminidase__InfluenzaA__AEX34653
MNPNQKIITIGSISIAIGIISLMLQVGNIISIWASHSIQTGSQNHTGICNQRIITYENSTWVNHTYVNINNTNVVAGKDKTSVALAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGLGWLTIGISGPDNGAVAVLKYNGIITETIKSWKKRILRTQESECVCVNGSCFTIMTDGPSNGAASYKIFKIEKGQVTKSVELNAPNFHYEECSCYPDTGTVMCVCRDNWHGSNRPWVSFNQDLDYQIGYICSGVFGDNPRPKDGKGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 21503 - protein, 470 aa, Artificial Sequence
  neuraminidase__InfluenzaA__AEX34664
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSRELNAPNFHYEECSCYPDTGTVMCVCRDNWHGSNRPWVSFNQNLDYQIGYICSGVFGDNPRPKDGKGSCNPVTADGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 21504 - protein, 470 aa, Artificial Sequence; identical to SEQ ID NO: 21482
  neuraminidase__InfluenzaA__AEX34686

SEQ ID NO: 21505 - protein, 470 aa, Artificial Sequence
  neuraminidase__InfluenzaA__AEX34760
MNPNQKIITIGSISIAIGIISLILQIGNIISIWASHSIQTGSQNHTGICNQRIITYENSTWVNNTYVNINNTNVVVEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGAASYKIFKIEKGKVTKTIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSGTVNWSWPDGAELPFTIDK

SEQ ID NO: 21506 - protein, 470 aa, Artificial Sequence
  neuraminidase__InfluenzaA__AEX34771
MNPNQKIITIGSISIAIGIISLILQIGNIISIWASHSIQTGSQNHTGICNQRIITYENSTWVNNTYVNINNTNVVVEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGAASYKIFKIEKGKVTKTIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSGTANWSWPDGAELPFTIDK

SEQ ID NO: 21507 - protein, 470 aa, Artificial Sequence; identical to SEQ ID NO: 17461
  neuraminidase__InfluenzaA__AEX34782

SEQ ID NO: 21508 - protein, 470 aa, Artificial Sequence
  neuraminidase__InfluenzaA__AEX34793
MNPNQKIITIGSISIAIGIISLMLQIGNIISIWASHSIQTGSQNHTGICNQRIITYENSTWVNHTYVNINNTNVVAGKDKTPVTLVGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYKGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDREGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNGDIANWSWPDGAELPFTIDK

SEQ ID NO: 21509 - protein, 470 aa, Artificial Sequence; identical to SEQ ID NO: 21508
  neuraminidase__InfluenzaA__AEX34804

SEQ ID NO: 21510 - protein, 470 aa, Artificial Sequence
  neuraminidase__InfluenzaA__AEX34815
MNPNQKIITIGSISIAIGIISLMLQIGNIISIWASHSIQTGSQNNTGICNQRIITYENSTWVNHTYVNINNTNVVAGEDKTSVTLTGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21511 - protein, 470 aa, Artificial Sequence; identical to SEQ ID NO: 21508
  neuraminidase__InfluenzaA__AEX34826

SEQ ID NO: 21512 - protein, 470 aa, Artificial Sequence; identical to SEQ ID NO: 21508
  neuraminidase__InfluenzaA__AEX34837

SEQ ID NO: 21513 - protein, 470 aa, Artificial Sequence
  neuraminidase__InfluenzaA__AEX34859
MNPNQKIITIGSTSIAIGIISLMLQIGNIISIWASHSIQTGSQNHTGICNQRIITYENSTWVNHTYVNINNTNVVAGKDKTPVTLIGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYKGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDREGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNGDIANWSWPDGAELPFTIDK

SEQ ID NO: 21514 - protein, 470 aa, Artificial Sequence
  neuraminidase__InfluenzaA__AEX34870
MNPNQKIITIGSISIAIGIISLMLQIGNIISIWASHSIQTGSQNNTGICNQRIITYENSTWVNHTYVNINNTNVVAGEDKISVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGIGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21515 - protein, 470 aa, Artificial Sequence
  neuraminidase__InfluenzaA__AEX34881
MNPNQKIITIGSISIAIGIISLMLQIGNIISIWASHSIQTGSQNHTGICNQRIITYENSTWVNHTYVNINNTNVVAGKDKAPVTLIGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYKGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDREGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNGDIANWSWPDGAELPFTIDK

SEQ ID NO: 21516 - protein, 470 aa, Artificial Sequence
  neuraminidase__InfluenzaA__AEX34892
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQNVVAITDWSGYSGSFVQHPELTGLDCIRPCFWVELVRGLPRENTTIWTSGSSISFCGVNSDTANWSWPDGAELPFTIDK

SEQ ID NO: 21517 - protein, 470 aa, Artificial Sequence
  neuraminidase__InfluenzaA__AEX34903
MNPNQKIITIGSISIAIGIISLMLQIGNIISIWASRSIQTGSQNHTGICNQRIITYENSTWVNHTYVNINNTNVVAGKDKTPVTLVGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYKGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDREGSCNPVTVDGANGVKGFSYKYGNGVWIGRTKSNRIRKGFEMIWDPNGWTNTDSDFSVRQDIVAITDWSGYSGSFVQHPELTGLDCIRPCFWVELVRGLPRENTTIWTSGSSISFCGVNGDIANWSWPDGAELPFTIDK

SEQ ID NO: 21518 - protein, 470 aa, Artificial Sequence; identical to SEQ ID NO: 17461
  neuraminidase__InfluenzaA__AEX34914

SEQ ID NO: 21519 - protein, 470 aa, Artificial Sequence; identical to SEQ ID NO: 17461
  neuraminidase__InfluenzaA__AEX34925

SEQ ID NO: 21520 - protein, 470 aa, Artificial Sequence; identical to SEQ ID NO: 17461
  neuraminidase__InfluenzaA__AEX34936

SEQ ID NO: 21521 - protein, 470 aa, Artificial Sequence; identical to SEQ ID NO: 17461
  neuraminidase__InfluenzaA__AEX34947

SEQ ID NO: 21522 - protein, 470 aa, Artificial Sequence; identical to SEQ ID NO: 17461
  neuraminidase__InfluenzaA__AEX34958

SEQ ID NO: 21523 - protein, 470 aa, Artificial Sequence; identical to SEQ ID NO: 17461
  neuraminidase__InfluenzaA__AEX34969

SEQ ID NO: 21524 - protein, 470 aa, Artificial Sequence; identical to SEQ ID NO: 17461
  neuraminidase__InfluenzaA__AEX34980

SEQ ID NO: 21525 - protein, 470 aa, Artificial Sequence; identical to SEQ ID NO: 17461
  neuraminidase__InfluenzaA__AEX34991

SEQ ID NO: 21526 - protein, 470 aa, Artificial Sequence
  neuraminidase__InfluenzaA__AEX35002
MNPNQKIITIGSISIAIGIISLMLQIGNIISIWASHSIQTGSQNHTGICNQRIITYENSTWVNHTYVNINNTNVVAGKDKTPVTLIGNSSLCSISGWAIYTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYKGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDREGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNGDIANWSWPDGAELPFTIDK

SEQ ID NO: 21527 - protein, 470 aa, Artificial Sequence; identical to SEQ ID NO: 17461
  neuraminidase__InfluenzaA__AEX35013

SEQ ID NO: 21528 - protein, 470 aa, Artificial Sequence; identical to SEQ ID NO: 17461
  neuraminidase__InfluenzaA__AEX35024

SEQ ID NO: 21529 - protein, 470 aa, Artificial Sequence; identical to SEQ ID NO: 17461
  neuraminidase__InfluenzaA__AEX35035

SEQ ID NO: 21530 - protein, 470 aa, Artificial Sequence; identical to SEQ ID NO: 17461
  neuraminidase__InfluenzaA__AEX35046

SEQ ID NO: 21531 - protein, 470 aa, Artificial Sequence; identical to SEQ ID NO: 17461
  neuraminidase__InfluenzaA__AEX35057

SEQ ID NO: 21532 - protein, 470 aa, Artificial Sequence; identical to SEQ ID NO: 17461
  neuraminidase__InfluenzaA__AEX35068

SEQ ID NO: 21533 - protein, 470 aa, Artificial Sequence
  neuraminidase__InfluenzaA__AEX35079
MNPNQKIITIGSISIAIGIISLMLQIGNIISMWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQDLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21534 - protein, 470 aa, Artificial Sequence; identical to SEQ ID NO: 21508
  neuraminidase__InfluenzaA__AEX35090

SEQ ID NO: 21535 - protein, 470 aa, Artificial Sequence
  neuraminidase__InfluenzaA__AEX35101
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSVFSVKQDVVAITDWSGYSGSFVQHPELTGLDCIRPCFWVELVRGLPRENTTIWTSGSSISFCGVNSDTANWSWPDGAELPFTIDK

SEQ ID NO: 21536 - protein, 470 aa, Artificial Sequence
  neuraminidase__InfluenzaA__AEX35112
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNASNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 21537 - protein, 470 aa, Artificial Sequence; identical to SEQ ID NO: 17461
  neuraminidase__InfluenzaA__AEX35123

SEQ ID NO: 21538 - protein, 470 aa, Artificial Sequence
  neuraminidase__InfluenzaA__AEX35145
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDIVAITDWSGYSGSFVQHPELTGLDCIRPCFWVELVRGLPRENTTIWTSGSSISFCGVNSDTANWSWPDGAELPFTIDK

SEQ ID NO: 21539 - protein, 470 aa, Artificial Sequence; identical to SEQ ID NO: 21508
  neuraminidase__InfluenzaA__AEX35156

SEQ ID NO: 21540 - protein, 470 aa, Artificial Sequence; identical to SEQ ID NO: 17461
  neuraminidase__InfluenzaA__AEX35167

SEQ ID NO: 21541 - protein, 470 aa, Artificial Sequence
  neuraminidase__InfluenzaA__AEX35178
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKERILRTQESECVCVNGSCFTIMTDGPSNGAASYKIFKIEKGKVTKSRELNAPNFHYEECSCYPDTGTVMCVCRDNWHGSNRPWVSFNQNLDYQIGYICSGVFGDNPRPKDGKGSCNPVTADGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVDSDTANWSWPDGAELPFTIDK

SEQ ID NO: 21542 - protein, 470 aa, Artificial Sequence; identical to SEQ ID NO: 21482
  neuraminidase__InfluenzaA__AEX35189

SEQ ID NO: 21543 - protein, 470 aa, Artificial Sequence; identical to SEQ ID NO: 21482
  neuraminidase__InfluenzaA__AEX35200

SEQ ID NO: 21544 - protein, 470 aa, Artificial Sequence; identical to SEQ ID NO: 17461
  neuraminidase__InfluenzaA__AEX35211

SEQ ID NO: 21545 - protein, 469 aa, Artificial Sequence
  neuraminidase__InfluenzaA__AEX35222
MNPNQKIITIGSVSLTISTICFFMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 21546 - protein, 470 aa, Artificial Sequence; identical to SEQ ID NO: 21441
  neuraminidase__InfluenzaA__AEX35233

SEQ ID NO: 21547 - protein, 469 aa, Artificial Sequence
  neuraminidase__InfluenzaA__AEX35244
MNPNQKIITIGSVSLTISTICFFMQIAILINTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGNGVKGWAFDDGNDVWMGRTISEKLRSGYETFKVIEGWSNPNSKLQINRQVIVDRGNRSGYSGIFSVEGKSCINRCFYVELIRGRKQENEVLWTSNSIVVFCGTSGTYGTGSWPDGADINLMPV

SEQ ID NO: 21548 - protein, 469 aa, Artificial Sequence; identical to SEQ ID NO: 15929
  neuraminidase__InfluenzaA__AEX35255

SEQ ID NO: 21549 - protein, 470 aa, Artificial Sequence; identical to SEQ ID NO: 21441
  neuraminidase__InfluenzaA__AEX35266

SEQ ID NO: 21550 - protein, 470 aa, Artificial Sequence; identical to SEQ ID NO: 21441
  neuraminidase__InfluenzaA__AEX35277

SEQ ID NO: 21551 - protein, 469 aa, Artificial Sequence
  neuraminidase__InfluenzaA__AEX35288
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHNRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21552 - protein, 469 aa, Artificial Sequence; identical to SEQ ID NO: 14714
  neuraminidase__InfluenzaA__AEX35299

SEQ ID NO: 21553 - protein, 469 aa, Artificial Sequence
  neuraminidase__InfluenzaA__AEX35310
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGDDVWMGRTISEKLRSGYETFKVIEGWSNPNSKLQINRQVIVDRGNRSGYSGIFSVEGKSCINRCFYVELIRGRNQETEVLWTSNSIVVFCGTSGTYGTGSWPDGADINLMPI

SEQ ID NO: 21554 - protein, 469 aa, Artificial Sequence; identical to SEQ ID NO: 14714
  neuraminidase__InfluenzaA__AEX35321

SEQ ID NO: 21555 - protein, 469 aa, Artificial Sequence; identical to SEQ ID NO: 15929
  neuraminidase__InfluenzaA__AEX35332

SEQ ID NO: 21556 - protein, 469 aa, Artificial Sequence; identical to SEQ ID NO: 15929
  neuraminidase__InfluenzaA__AEX35343

SEQ ID NO: 21557 - protein, 469 aa, Artificial Sequence
  neuraminidase__InfluenzaA__AEX35354
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSTSGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21558 - protein, 469 aa, Artificial Sequence; identical to SEQ ID NO: 14714
  neuraminidase__InfluenzaA__AEX35365

SEQ ID NO: 21559 - protein, 469 aa, Artificial Sequence
  neuraminidase__InfluenzaA__AEX35376
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHERTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21560 - protein, 469 aa, Artificial Sequence; identical to SEQ ID NO: 14714
  neuraminidase__InfluenzaA__AEX35387

SEQ ID NO: 21561 - protein, 469 aa, Artificial Sequence
  neuraminidase__InfluenzaA__AEX35398
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCAVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21562 - protein, 469 aa, Artificial Sequence; identical to SEQ ID NO: 14714
  neuraminidase__InfluenzaA__AEX35409

SEQ ID NO: 21563 - protein, 469 aa, Artificial Sequence; identical to SEQ ID NO: 21551
  neuraminidase__InfluenzaA__AEX35420

SEQ ID NO: 21564 - protein, 469 aa, Artificial Sequence
  neuraminidase__InfluenzaA__AEX35431
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKKETEVLWTSNSIVVFCGTSGTYGTGSWPDGADINLMPI

SEQ ID NO: 21565 - protein, 469 aa, Artificial Sequence; identical to SEQ ID NO: 14712
  neuraminidase__InfluenzaA__AEX35453

SEQ ID NO: 21566 - protein, 469 aa, Artificial Sequence; identical to SEQ ID NO: 14712
  neuraminidase__InfluenzaA__AEX35464

SEQ ID NO: 21567 - protein, 469 aa, Artificial Sequence; identical to SEQ ID NO: 14712
  neuraminidase__InfluenzaA__AEX35475

SEQ ID NO: 21568 - protein, 469 aa, Artificial Sequence; identical to SEQ ID NO: 14712
  neuraminidase__InfluenzaA__AEX35486

SEQ ID NO: 21569 - protein, 469 aa, Artificial Sequence
  neuraminidase__InfluenzaA__AEX35497
MNPNQKIITIGSVSLTISTICFFMQIAILITTVTLHFKQYEFNSPPNNQVMLCEPTIIERNITEIVYLTNTTIEKEKCPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21570 - protein, 469 aa, Artificial Sequence; identical to SEQ ID NO: 14712
  neuraminidase__InfluenzaA__AEX35508

SEQ ID NO: 21571 - protein, 469 aa, Artificial Sequence; identical to SEQ ID NO: 21569
  neuraminidase__InfluenzaA__AEX35519

SEQ ID NO: 21572 - protein, 469 aa, Artificial Sequence
  neuraminidase__InfluenzaA__AEX35530
MNPNQKIITIGSVSLTISTICFFMQIAILITTVTLHFKQYEFNSPPNNQVMQCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINTKDYSIVSSYVCSGLVGDTPRKNDSSSSSHCLNPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21573 - protein, 469 aa, Artificial Sequence; identical to SEQ ID NO: 14712
  neuraminidase__InfluenzaA__AEX35541

SEQ ID NO: 21574 - protein, 469 aa, Artificial Sequence
  neuraminidase__InfluenzaA__AEX35552
MNPNQKIITIGSASLTISTICFFMQIAILITTVTLHFKQYEFNPPPNNQAMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIASSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21575 - protein, 469 aa, Artificial Sequence
  neuraminidase__InfluenzaA__AEX35563
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLNPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21576 - protein, 469 aa, Artificial Sequence; identical to SEQ ID NO: 21456
  neuraminidase__InfluenzaA__AEX35585

SEQ ID NO: 21577 - protein, 469 aa, Artificial Sequence
  neuraminidase__InfluenzaA__AEX35596
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPDSKLQINRQVIVDRGNRSGYSGIFSVEGKSCINRCFYVELIRGRKEETEVLWTSNSIVVFCGTSGTYGTGSWPDGADINLMPI

SEQ ID NO: 21578 - protein, 469 aa, Artificial Sequence; identical to SEQ ID NO: 14712
  neuraminidase__InfluenzaA__AEX35607

SEQ ID NO: 21579 - protein, 469 aa, Artificial Sequence
  neuraminidase__InfluenzaA__AEX35618
MNPNQKIITIGSVSLTISTICFFMQIAILITTVTLHFKQYELNSPPNNQVMLCEPTIIERNITEIVYLTNTTIEKETCPKLAEYRNWSKPQCYITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRDNRSGYSGIFSVEGKSCINRCFYVELIRGRKEETEVLWTSNSIVVFCGTSGTYGTGSWPDGADINLMPI

SEQ ID NO: 21580 - protein, 469 aa, Artificial Sequence
  neuraminidase__InfluenzaA__AEX35640
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDNKNATASFIYNGRLVDSIVSWSKEILRTQESECVCINGTCTVVMTDGSASGKADTKILFIEEGKIVHTSTLSGSAQHVEECSCYPRYPGVRCVCRDNWRGSNRPIVDINMKDYSIVSSYVCSGLVGDTPRKNDSSSSGHCLDPNDEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21581 - protein, 469 aa, Artificial Sequence
  neuraminidase__InfluenzaA__AEX35651
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEDKSCINRCFYVELIRGRKEETEVLWTSNSIVVFCGTSGTYGTGSWPDGADINLMPI

SEQ ID NO: 21582 - protein, 469 aa, Artificial Sequence; identical to SEQ ID NO: 15884
  neuraminidase__InfluenzaA__AEX36105

SEQ ID NO: 21583 - protein, 469 aa, Artificial Sequence
  neuraminidase__InfluenzaA__AEX36116
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21584 - protein, 469 aa, Artificial Sequence
  neuraminidase__InfluenzaA__AEX36127
MNPNQKIITIGSVSLTISTICFFMQIAILITTVTLHFKQYEFNSPPNNQVMLCEPTIIERNITEIVYLTNTTIEKEICPKLAEYRNWLKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGDDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21585 - protein, 469 aa, Artificial Sequence
  neuraminidase__InfluenzaA__AEX36149
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEDKSCINRCFYVELIRGRKEETEVLWTTNSIVVFCGTSGTYGTGSWPDGADINLMPI

SEQ ID NO: 21586 - protein, 469 aa, Artificial Sequence; identical to SEQ ID NO: 16512
  neuraminidase__InfluenzaA__AEX36160

SEQ ID NO: 21587 - protein, 469 aa, Artificial Sequence
  neuraminidase__InfluenzaA__AEX36171
MNPNQKIITIGSVSLTISTICFFMQIAILITTVTLHFKQYEFSSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHNRTPYRTLLMNELGVPFHLGTKQVCIAWSSSSCHDGKAWLHVCVTGDDKNATASFIYNGRLVDSIVSWSKEILRTQESECVCINGTCAVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGDDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21588 - protein, 469 aa, Artificial Sequence
  neuraminidase__InfluenzaA__AEX36193
MNPNQKIITIGSVSLTISTICFFMQIAILITTVTLHFKQYEFNSSPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGMLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21589 - protein, 469 aa, Artificial Sequence
  neuraminidase__InfluenzaA__AEX36204
MNPNQKIITIGSVSLTISTICFFMQIAILITTVTLHFKQYEFNSPPNNQVMLCEPAIIERNITEIVYLTNTTIEKEICPKLAEYRNWSKPQCDITGFAPFSKDNSIRLSAGGDIWVTREPYVSCDPDKCYQFALGQGTTLNNVHSNDTVHERTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21590 - protein, 469 aa, Artificial Sequence
  neuraminidase__InfluenzaA__AEX36215
MNPNQKIITIGSVSLTISTICFFMQIAILITTVTLHFKQYEFSSPPNNQVMLCEPAIIEKNITEIVYLTNTTIEKEICPKLAEYRNWSKPQCDITGFAPFSKDNSIRLSAGGDIWVTREPYVSCDPDKCYQFALGQGTTLNNVHSNDTVHERTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21591 - protein, 469 aa, Artificial Sequence
  neuraminidase__InfluenzaA__AEX36226
MNPNQKIITIGSVSLTISTICFFMQIAILITTVTLHFKQYEFSSPPNNQVMLCEPAIIERNITEIVYLTNTTIEKEICPKLAEYRNWSKPQCDITGFAPFSKDNSIRLSAGGDIWVTREPYVSCDPDKCYQFALGQGTTLNNVHSNDTVHNRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGIVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21592 - protein, 469 aa, Artificial Sequence
  neuraminidase__InfluenzaA__AEX36237
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRERTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWRGSNRPIVDINMKDYSIVSSYVCSGLVGDTPRKNDSSSSGHCLDPNDEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21593 - protein, 469 aa, Artificial Sequence
  neuraminidase__InfluenzaA__AEX36248
MNPNQKIITIGSVSLTISTICFFMQIAILITTVTLHFKQYEFSSPPNNQVMLCEPAIIERNITEIVYLTNTTIEKEICPKLAEYRNWSKPQCDITGFAPFSKDNSIRLSAGGDIWVTREPYVSCDPDKCYQFALGQGTTLNNVHSNDTVHNRTPYRTLLMNELGVPFHLGTKQVCIAWSSSSCHDGKAWLHVCVTGDDKNATASFIYNGRLVDSIVSWSKEILRTQESECVCINGTCTVVMTDGSASGRADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21594 - protein, 469 aa, Artificial Sequence; identical to SEQ ID NO: 16512
  neuraminidase__InfluenzaA__AEX36259

SEQ ID NO: 21595 - protein, 469 aa, Artificial Sequence
  neuraminidase__InfluenzaA__AEX36270
MNPNQKIITIGSVSLTISTICFFMQIAILITTVTLHFKQYEFSSPPNNQVMLCEPAIIERNITEIVYLTNTTIEKEICPKLAEYRNWSKPQCDITGFAPFSKDNSIRLSAGGDIWVTREPYVSCDPDKCYQFALGQGTTLNNVHSNDTVHGRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGREEETKVLWTSNSIVVFCGTSGTYGTGSWPDGADINLMPI

SEQ ID NO: 21596 - protein, 469 aa, Artificial Sequence
  neuraminidase__InfluenzaA__AEX36281
MNPNQKIITIGSVSLTISTICFFMQIAILITTVTLHFKQYEFSSPPNNQVMLCEPAIIERNITEIVYLTNTTIEKEICPKLAEYRNWSKPQCDITGFAPFSKDNSIRLSAGGDIWVTREPYVSCDPDKCYQFALGQGTTLNNVHSNDTVHGRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21597 - protein, 469 aa, Artificial Sequence; identical to SEQ ID NO: 21596
  neuraminidase__InfluenzaA__AEX36292

SEQ ID NO: 21598 - protein, 469 aa, Artificial Sequence
  neuraminidase__InfluenzaA__AEX36303
MNPNQKIITIGSVSLTISTICFFMQIAILITTVTLHFKQYEFSSPPNNQVMLCEPAIIERNITEIVYLTNTTIEKEICPKLAEYRNWSKPQCDITGFAPFSKDNSIRLSAGGDIWVTREPYVSCDPDKCYQFALGQGTTLNNVHSNDTVHERTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21599 - protein, 469 aa, Artificial Sequence
  neuraminidase__InfluenzaA__AEX36314
MNPNQKIITIGSVSLTISTICFFMQIAILITTVTLHFKQYEFSSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHNRTPYRTLLMNELGVPFHLGTKQVCIAWSSSSCHDGKAWLHVCVTGDDKNATASFIYNGRLVDSIVSWSKEILRTQESECVCINGTCAVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGDHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGAEINLMPI

SEQ ID NO: 21600 - protein, 469 aa, Artificial Sequence; identical to SEQ ID NO: 21596
  neuraminidase__InfluenzaA__AEX36336

SEQ ID NO: 21601 - protein, 469 aa, Artificial Sequence
  neuraminidase__InfluenzaA__AEX36347
MNPNQKIITIGSVSLTISTICFFMQIAILITTVTLHFKQYEFSSPPNNQVMLCEPIIIERNITEIVYLTNTTIEKEICPKLAEYRNWSKPQCDITGFAPFSKDNSIRLSAGGDIWVTREPYVSCDPDKCYQFALGQGTTLNNVHSNDTVHNRTPYRTLLMNELGVPFHLGTKQVCIAWSSSSCHDGKAWLHVCVTGDDKNATASFIYNGRLVDSIVSWSKEILRTQESECVCINGTCAVVMTDGSASGKADTKILFIEEGKIVHASTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21602 - protein, 469 aa, Artificial Sequence; identical to SEQ ID NO: 15884
  neuraminidase__InfluenzaA__AEX36358

SEQ ID NO: 21603 - protein, 469 aa, Artificial Sequence
  neuraminidase__InfluenzaA__AEX36369
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRTGYSGIFSVEGKSCINRCFYVELIRGRKEETEVLWTSNSIVVFCGTSGTYGTGSWPDGADINLMPI

SEQ ID NO: 21604 - protein, 469 aa, Artificial Sequence
  neuraminidase__InfluenzaA__AEX36391
MNPNQKIITIGSVSLTISTICFFMQIAILITTVTLHFKQYEFNSPPNNQVMLCEPTIIERNITEIVYLTNTTIEKEICPKLAEYRNWSKPQCDIAGFAPFSKDNSIRLSAGGDIWVTREPYVSCDPDKCYQFALGQGTTLNNVHSNDTVRNRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGDRSGYSGIFSVEGKSCINRCFYVELIRGRKEETEVLWTSNSIVVFCGTSGTYGTGSWPDGADINLMPI

SEQ ID NO: 21605 - protein, 469 aa, Artificial Sequence
  neuraminidase__InfluenzaA__AEX36402
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRGRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRFPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRTGYSGIFSVEGKSCINRCFYVELIRGRKEETEVLWTSNSIVVFCGTSGTYGTGSWPDGADINLMPI

SEQ ID NO: 21606 - protein, 469 aa, Artificial Sequence; identical to SEQ ID NO: 15884
  neuraminidase__InfluenzaA__AEX36413

SEQ ID NO: 21607 - protein, 469 aa, Artificial Sequence
  neuraminidase__InfluenzaA__AEX36424
MNPNQKIITIGSVSLTISTICFFMQIAILITTVTLHFKQYEFNSPPNNQVMLCEPTIIERNITEIVYLTNTTIEKEICSKLAEYRNWSKPQCDITGFAPFSKDNSIRLSAGGDIWVTREPYVSCDPDKCYQFALGQGTTLNNVHSNDTIRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21608 - protein, 469 aa, Artificial Sequence
  neuraminidase__InfluenzaA__AEX36435
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIKEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNSKSKLQINRQVIVDRGNRSGYSGIFSVEGKSCINRCFYVELIRGRKEETEVLWTSNSIVVFCGTSGTYGTGSWPDGADINLMPI

SEQ ID NO: 21609 - protein, 469 aa, Artificial Sequence; identical to SEQ ID NO: 16066
  neuraminidase__InfluenzaA__AEX36446

SEQ ID NO: 21610 - protein, 469 aa, Artificial Sequence; identical to SEQ ID NO: 16066
  neuraminidase__InfluenzaA__AEX36457

SEQ ID NO: 21611 - protein, 469 aa, Artificial Sequence
  neuraminidase__InfluenzaA__AEX36468
MNPNQKIITIGSVSLTISTICFFMQIAILITTVTLHFKQYEFSSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHNRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGNAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETKVLWTSNSIVVFCGTSGTYGTGSWPDGADINLMPI

SEQ ID NO: 21612 - protein, 469 aa, Artificial Sequence
  neuraminidase__InfluenzaA__AEX36479
MNPNQKIITIGSVSLTISTICFFMQIAILITTVTLHFKQYEFSSPPNNQVMLCEPTIIERNITEIVYPTNTTTEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21613 - protein, 469 aa, Artificial Sequence
  neuraminidase__InfluenzaA__AEX36490
MNPNQKIITIGSVSLTISTICFFMQIAILITTVTLHFKQYEFSYPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGNAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETKVLWTSNSIVVFCGTSGTYGTGSWPDGADINLMPI

SEQ ID NO: 21614 - protein, 469 aa, Artificial Sequence
  neuraminidase__InfluenzaA__AEX36501
MNPNQKIITIGSVSLTISTICFFMQIAILITTVTLHFKQYEFSSPPNNQVMLCEPAIIERNITEIVYLTNTTIEKEKCPKLAEYRNWSKPQCDITGFAPFSKDNSIRLSAGGDIWVTREPYVSCDPDKCYQFALGQGTTLNNVHSNDTVHGRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKSDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21615 - protein, 469 aa, Artificial Sequence
  neuraminidase__InfluenzaA__AEX36512
MNPNQKIITIGSVSLTISTICFFMQIAILITTVTLHFKQYEFSSPPNNQVMLCEPAIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21616 - protein, 469 aa, Artificial Sequence
  neuraminidase__InfluenzaA__AEX36523
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21617 - protein, 469 aa, Artificial Sequence; identical to SEQ ID NO: 16599
  neuraminidase__InfluenzaA__AEX36534

SEQ ID NO: 21618 - protein, 469 aa, Artificial Sequence
  neuraminidase__InfluenzaA__AEX36545
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSALGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21619 - protein, 469 aa, Artificial Sequence; identical to SEQ ID NO: 16512
  neuraminidase__InfluenzaA__AEX36556

SEQ ID NO: 21620 - protein, 469 aa, Artificial Sequence; identical to SEQ ID NO: 16512
  neuraminidase__InfluenzaA__AEX36567

SEQ ID NO: 21621 - protein, 469 aa, Artificial Sequence
  neuraminidase__InfluenzaA__AEX36578
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIKEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21622 - protein, 469 aa, Artificial Sequence; identical to SEQ ID NO: 21621
  neuraminidase__InfluenzaA__AEX36589

SEQ ID NO: 21623 - protein, 469 aa, Artificial Sequence
  neuraminidase__InfluenzaA__AEX36600
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIKEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNNVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21624 - protein, 469 aa, Artificial Sequence; identical to SEQ ID NO: 14714
  neuraminidase__InfluenzaA__AEX36622

SEQ ID NO: 21625 - protein, 469 aa, Artificial Sequence
  neuraminidase__InfluenzaA__AEX63619
MNPNQKIITIGSICMTIGIASLILQIGNIISIWISHSIQTENQNQPEICNQNVITYENNTWVNQTYVNVSNTNFVAEQAVASVKLAGNSSLCPVSGWAIYSKDNSVRIGSKGDVFVIREPFISCSHSECRTFFLTQGALLNDKHSNGTIKDRSPYRTLMSCPIGEVPSPYNSRFESVAWSASACHDGTSWLTIGISGPDNGAVAVLKYNGIITDTIKSWRKNILRTQESECACVNGSCFTVMTDGPSNGQASYKVFKIERGKVVKSVELNAPNYHYEECSCYPESSEITCVCRDNWHGSNRPWVSFNQNLEYQMGYICSGIFGDNPRPNDKTGSCGPVFSNGANGVKGFSFKYGNGVWIGRTKSTSSRMGFEMIWDPDGWTKTDDKFSVKQDIIGITDWSGYSGSFVQHPELTGLDCMRPCFWVELIRGRPKENTIWTSGSSISFCGVNSDTVGWSWPDGAELPFTIDK

SEQ ID NO: 21626 - protein, 454 aa, Artificial Sequence; identical to SEQ ID NO: 15719
  neuraminidase__InfluenzaA__AEX92876

SEQ ID NO: 21627 - protein, 454 aa, Artificial Sequence; identical to SEQ ID NO: 15719
  neuraminidase__InfluenzaA__AEX92887

SEQ ID NO: 21628 - protein, 454 aa, Artificial Sequence; identical to SEQ ID NO: 15719
  neuraminidase__InfluenzaA__AEX92904

SEQ ID NO: 21629 - protein, 454 aa, Artificial Sequence; identical to SEQ ID NO: 15719
  neuraminidase__InfluenzaA__AEX96924

SEQ ID NO: 21630 - protein, 469 aa, Artificial Sequence; identical to SEQ ID NO: 18469
  neuraminidase__InfluenzaA__AEY69091

SEQ ID NO: 21631 - protein, 469 aa, Artificial Sequence; identical to SEQ ID NO: 16599
  neuraminidase__InfluenzaA__AEY69101

SEQ ID NO: 21632 - protein, 469 aa, Artificial Sequence; identical to SEQ ID NO: 16599
  neuraminidase__InfluenzaA__AEY69112

SEQ ID NO: 21633 - protein, 469 aa, Artificial Sequence
  neuraminidase__InfluenzaA__AEY69145
MNTNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTINNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSVVVFCGTSGTYGTGSWPDGADINLMPI

SEQ ID NO: 21634 - protein, 469 aa, Artificial Sequence; identical to SEQ ID NO: 16599
  neuraminidase__InfluenzaA__AEY69156

SEQ ID NO: 21635 - protein, 469 aa, Artificial Sequence
  neuraminidase__InfluenzaA__AEY69167
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 21636 - protein, 469 aa, Artificial Sequence; identical to SEQ ID NO: 21635
  neuraminidase__InfluenzaA__AEY69178

SEQ ID NO: 21637 - protein, 469 aa, Artificial Sequence; identical to SEQ ID NO: 21635
  neuraminidase__InfluenzaA__AEY69189

SEQ ID NO: 21638 - protein, 469 aa, Artificial Sequence
  neuraminidase__InfluenzaA__AEY69211
MNPNQKIITIGSVSLTISTICFFMQIAILITTVTLHFKQYKFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 21639 - protein, 469 aa, Artificial Sequence; identical to SEQ ID NO: 21635
  neuraminidase__InfluenzaA__AEY69233

SEQ ID NO: 21640 - protein, 469 aa, Artificial Sequence; identical to SEQ ID NO: 21635
  neuraminidase__InfluenzaA__AEY69272

SEQ ID NO: 21641 - protein, 469 aa, Artificial Sequence; identical to SEQ ID NO: 21635
  neuraminidase__InfluenzaA__AEY69283

SEQ ID NO: 21642 - protein, 469 aa, Artificial Sequence
  neuraminidase__InfluenzaA__AEY69294
MNPNQKIITIGSVSLTISTICFFMQTAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGNGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 21643 - protein, 469 aa, Artificial Sequence; identical to SEQ ID NO: 21642
  neuraminidase__InfluenzaA__AEY69305

SEQ ID NO: 21644 - protein, 469 aa, Artificial Sequence; identical to SEQ ID NO: 21642
  neuraminidase__InfluenzaA__AEY69316

SEQ ID NO: 21645 - protein, 469 aa, Artificial Sequence; identical to SEQ ID NO: 21642
  neuraminidase__InfluenzaA__AEY69788

SEQ ID NO: 21646 - protein, 469 aa, Artificial Sequence; identical to SEQ ID NO: 16599
  neuraminidase__InfluenzaA__AEY69799

SEQ ID NO: 21647 - protein, 469 aa, Artificial Sequence; identical to SEQ ID NO: 16599
  neuraminidase__InfluenzaA__AEY69810

SEQ ID NO: 21648 - protein, 469 aa, Artificial Sequence; identical to SEQ ID NO: 21635
  neuraminidase__InfluenzaA__AEY69832

SEQ ID NO: 21649 - protein, 469 aa, Artificial Sequence
  neuraminidase__InfluenzaA__AEY69843
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCIAGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 21650 - protein, 469 aa, Artificial Sequence; identical to SEQ ID NO: 21635
  neuraminidase__InfluenzaA__AEY69854

SEQ ID NO: 21651 - protein, 469 aa, Artificial Sequence; identical to SEQ ID NO: 21635
  neuraminidase__InfluenzaA__AEY69876

SEQ ID NO: 21652 - protein, 469 aa, Artificial Sequence; identical to SEQ ID NO: 21635
  neuraminidase__InfluenzaA__AEY69887

SEQ ID NO: 21653 - protein, 469 aa, Artificial Sequence; identical to SEQ ID NO: 21635
  neuraminidase__InfluenzaA__AEY69898

SEQ ID NO: 21654 - protein, 469 aa, Artificial Sequence; identical to SEQ ID NO: 16599
  neuraminidase__InfluenzaA__AEY69909

SEQ ID NO: 21655 - protein, 469 aa, Artificial Sequence
  neuraminidase__InfluenzaA__AEY69942
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSDGGDIWVTREPYVSCDPDKCYQFALGQGTTLNNIHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 21656 - protein, 469 aa, Artificial Sequence; identical to SEQ ID NO: 21655
  neuraminidase__InfluenzaA__AEY69953

SEQ ID NO: 21657 - protein, 469 aa, Artificial Sequence; identical to SEQ ID NO: 21655
  neuraminidase__InfluenzaA__AEY69964

SEQ ID NO: 21658 - protein, 469 aa, Artificial Sequence; identical to SEQ ID NO: 21635
  neuraminidase__InfluenzaA__AEY69975

SEQ ID NO: 21659 - protein, 469 aa, Artificial Sequence; identical to SEQ ID NO: 21635
  neuraminidase__InfluenzaA__AEY69986

SEQ ID NO: 21660 - protein, 469 aa, Artificial Sequence; identical to SEQ ID NO: 21635
  neuraminidase__InfluenzaA__AEY69997

SEQ ID NO: 21661 - protein, 469 aa, Artificial Sequence; identical to SEQ ID NO: 21635
  neuraminidase__InfluenzaA__AEY70008

SEQ ID NO: 21662 - protein, 469 aa, Artificial Sequence; identical to SEQ ID NO: 21635
  neuraminidase__InfluenzaA__AEY70019

SEQ ID NO: 21663 - protein, 469 aa, Artificial Sequence; identical to SEQ ID NO: 21635
  neuraminidase__InfluenzaA__AEY70259

SEQ ID NO: 21664 - protein, 469 aa, Artificial Sequence; identical to SEQ ID NO: 21635
  neuraminidase__InfluenzaA__AEY70270

SEQ ID NO: 21665 - protein, 469 aa, Artificial Sequence; identical to SEQ ID NO: 21635
  neuraminidase__InfluenzaA__AEY70281

SEQ ID NO: 21666 - protein, 469 aa, Artificial Sequence; identical to SEQ ID NO: 16599
  neuraminidase__InfluenzaA__AEY70303

SEQ ID NO: 21667 - protein, 469 aa, Artificial Sequence; identical to SEQ ID NO: 16599
  neuraminidase__InfluenzaA__AEY70314

SEQ ID NO: 21668 - protein, 469 aa, Artificial Sequence
  neuraminidase__InfluenzaA__AEY70325
MNPNQKIITIGSVSLTISTICFFMQIAILMTTVTLHFKQYEFNPPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 21669 - protein, 469 aa, Artificial Sequence
  neuraminidase__InfluenzaA__AEY70336
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCICRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEDKSCINRCFYVELIRGRKEETEVLWTSNSIVVFCGTSGTYGTGSWPDGADINLMPV

SEQ ID NO: 21670 - protein, 469 aa, Artificial Sequence; identical to SEQ ID NO: 16738
  neuraminidase__InfluenzaA__AEY70358

SEQ ID NO: 21671 - protein, 469 aa, Artificial Sequence; identical to SEQ ID NO: 16599
  neuraminidase__InfluenzaA__AEY70379

SEQ ID NO: 21672 - protein, 469 aa, Artificial Sequence; identical to SEQ ID NO: 18361
  neuraminidase__InfluenzaA__AFB70139

SEQ ID NO: 21673 - protein, 469 aa, Artificial Sequence; identical to SEQ ID NO: 16738
  neuraminidase__InfluenzaA__AFB70141

SEQ ID NO: 21674 - protein, 469 aa, Artificial Sequence; identical to SEQ ID NO: 18361
  neuraminidase__InfluenzaA__AFB70147

SEQ ID NO: 21675 - protein, 469 aa, Artificial Sequence; identical to SEQ ID NO: 16738
  neuraminidase__InfluenzaA__AFB70153

SEQ ID NO: 21676 - protein, 469 aa, Artificial Sequence; identical to SEQ ID NO: 16738
  neuraminidase__InfluenzaA__AFB70155

SEQ ID NO: 21677 - protein, 469 aa, Artificial Sequence; identical to SEQ ID NO: 17708
  neuraminidase__InfluenzaA__AFB70157

SEQ ID NO: 21678 - protein, 469 aa, Artificial Sequence; identical to SEQ ID NO: 16738
  neuraminidase__InfluenzaA__AFB70159

SEQ ID NO: 21679 - protein, 469 aa, Artificial Sequence
  neuraminidase__InfluenzaA__AFB70161
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSTKQDIVGINEWSGYSGSFVQHPELTGLDCIRPCFWVELIRGRPKENTIWTSGSSISFCGVNSDTVGWYWPDGAELPFTIDK

SEQ ID NO: 21680 - protein, 469 aa, Artificial Sequence
  neuraminidase__InfluenzaA__AFB70163
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENAIWTSGSSISFCGVNSDTVGWSWPDGAELPFTIDK

SEQ ID NO: 21681 - protein, 469 aa, Artificial Sequence
  neuraminidase__InfluenzaA__AFB70169
MNPNQKIITIGSVCMTIGMANLILQIGNIISIWINHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21682 - protein, 469 aa, Artificial Sequence; identical to SEQ ID NO: 16738
  neuraminidase__InfluenzaA__AFB70199

SEQ ID NO: 21683 - protein, 469 aa, Artificial Sequence; identical to SEQ ID NO: 16738
  neuraminidase__InfluenzaA__AFB70209

SEQ ID NO: 21684 - protein, 469 aa, Artificial Sequence; identical to SEQ ID NO: 16738
  neuraminidase__InfluenzaA__AFB70219

SEQ ID NO: 21685 - protein, 469 aa, Artificial Sequence; identical to SEQ ID NO: 16738
  neuraminidase__InfluenzaA__AFB70229

SEQ ID NO: 21686 - protein, 469 aa, Artificial Sequence; identical to SEQ ID NO: 16738
  neuraminidase__InfluenzaA__AFB70239

SEQ ID NO: 21687 - protein, 469 aa, Artificial Sequence; identical to SEQ ID NO: 16738
  neuraminidase__InfluenzaA__AFB70249

SEQ ID NO: 21688 - protein, 469 aa, Artificial Sequence; identical to SEQ ID NO: 16738
  neuraminidase__InfluenzaA__AFB70259

SEQ ID NO: 21689 - protein, 469 aa, Artificial Sequence; identical to SEQ ID NO: 17708
  neuraminidase__InfluenzaA__AFB70269

SEQ ID NO: 21690 - protein, 469 aa, Artificial Sequence; identical to SEQ ID NO: 16738
  neuraminidase__InfluenzaA__AFB70279

SEQ ID NO: 21691 - protein, 469 aa, Artificial Sequence; identical to SEQ ID NO: 16738
  neuraminidase__InfluenzaA__AFB70289

SEQ ID NO: 21692 - protein, 469 aa, Artificial Sequence; identical to SEQ ID NO: 16738
  neuraminidase__InfluenzaA__AFB70299

SEQ ID NO: 21693 - protein, 469 aa, Artificial Sequence; identical to SEQ ID NO: 16738
  neuraminidase__InfluenzaA__AFB70309

SEQ ID NO: 21694 - protein, 469 aa, Artificial Sequence; identical to SEQ ID NO: 18361
  neuraminidase__InfluenzaA__AFB70319

SEQ ID NO: 21695 - protein, 469 aa, Artificial Sequence; identical to SEQ ID NO: 16738
  neuraminidase__InfluenzaA__AFB70329

SEQ ID NO: 21696 - protein, 469 aa, Artificial Sequence; identical to SEQ ID NO: 16738
  neuraminidase__InfluenzaA__AFB70349

SEQ ID NO: 21697 - protein, 469 aa, Artificial Sequence; identical to SEQ ID NO: 16738
  neuraminidase__InfluenzaA__AFB70359

SEQ ID NO: 21698 - protein, 469 aa, Artificial Sequence; identical to SEQ ID NO: 16738
  neuraminidase__InfluenzaA__AFB70369

SEQ ID NO: 21699 - protein, 469 aa, Artificial Sequence; identical to SEQ ID NO: 16738
  neuraminidase__InfluenzaA__AFB70379

SEQ ID NO: 21700 - protein, 469 aa, Artificial Sequence; identical to SEQ ID NO: 16738
  neuraminidase__InfluenzaA__AFB70389

SEQ ID NO: 21701 - protein, 469 aa, Artificial Sequence; identical to SEQ ID NO: 16738
  neuraminidase__InfluenzaA__AFB70399

SEQ ID NO: 21702 - protein, 469 aa, Artificial Sequence; identical to SEQ ID NO: 16738
  neuraminidase__InfluenzaA__AFB70409

SEQ ID NO: 21703 - protein, 469 aa, Artificial Sequence
  neuraminidase__InfluenzaA__AFB77614
MHPNQEVISIVSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWFWPDGAELPFTIDK

SEQ ID NO: 21704 - protein, 469 aa, Artificial Sequence
  neuraminidase__InfluenzaA__AFB77615
MHPNQEIITFVSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21705 - protein, 469 aa, Artificial Sequence
  neuraminidase__InfluenzaA__AFB78128
MNPNQKIITIGSVSLTIATICFLMQIVILVTTVTLHFKQHECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHTSKLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKSRSGYETFKVIEGWSKPNSKLQINRQVIVERGNMSGYSGIFSVEGKSCINRCFYVELIRGRKQETEVWWTSNSIVVFCGTSGTYGTGSWPDGADINLMPI

SEQ ID NO: 21706 - protein, 469 aa, Artificial Sequence
  neuraminidase__InfluenzaA__AFC62078
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIRELFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNDILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGMDCIRPCFWVELIRGRPKENTIWTSGSSISFCGVNSDTVGWSWPDGAELPFTIDK

SEQ ID NO: 21707 - protein, 469 aa, Artificial Sequence
  neuraminidase__InfluenzaA__AFC62079
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIIKSVEMNAPNYHYEECSCYPDSSEITCVCRDNWHGSNRPWVSFNQNLEYQIGYICSGILGDNPRPNDKTGSCGPVSSNGANGVKGFSFKYGNGVWVGRTKSISSRNGFEMIWDPNGWTGTDNNFSIKQDIVGIKEWSGYSGSFVQHPELTGLDCIRPCFWVELIRGRPKENTIWTSGSIISFCGVNSDTVGWSWPDGAELPFTIDK

SEQ ID NO: 21708 - protein, 469 aa, Artificial Sequence
  neuraminidase__InfluenzaA__AFC62080
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGMGCIRPCFWVELIRGRPKENTIWTSGSSISFCGVNSDTVGWSWPDGAELPFTIDK

SEQ ID NO: 21709 - protein, 469 aa, Artificial Sequence
  neuraminidase__InfluenzaA__AFC62082
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRGRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCFDPNDEEGGHGVKGWAFDDGNDVWMGRTISEKSRLGYETFKVIEGWSNPKSKLQINRQVIVDRGDRSGYSGIFSVEGKSCINRCFYVELIRGSKEETEVLWTSNSIVVFCGTSGTYGTGSWPDGADINLMPI

SEQ ID NO: 21710 - protein, 469 aa, Artificial Sequence; identical to SEQ ID NO: 14225
  neuraminidase__InfluenzaA__AFD63529

SEQ ID NO: 21711 - protein, 469 aa, Artificial Sequence; identical to SEQ ID NO: 14225
  neuraminidase__InfluenzaA__AFD63540

SEQ ID NO: 21712 - protein, 469 aa, Artificial Sequence
  neuraminidase__InfluenzaA__AFD63551
MNPNQKIITIGSVSLTIAAICFLMQIAILVTTVTLHFKQHECNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHGRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21713 - protein, 469 aa, Artificial Sequence; identical to SEQ ID NO: 14225
  neuraminidase__InfluenzaA__AFD63562

SEQ ID NO: 21714 - protein, 469 aa, Artificial Sequence
  neuraminidase__InfluenzaA__AFD63573
MNPNQKIITIGSVSLTIATICFLMQIAILVTTVTLHFKQHECNSPPNNQVMLCEPTIIGRNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21715 - protein, 469 aa, Artificial Sequence
  neuraminidase__InfluenzaA__AFD63584
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHERTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIIHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21716 - protein, 469 aa, Artificial Sequence
  neuraminidase__InfluenzaA__AFD63595
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCKDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21717 - protein, 469 aa, Artificial Sequence; identical to SEQ ID NO: 14225
  neuraminidase__InfluenzaA__AFD63606

SEQ ID NO: 21718 - protein, 469 aa, Artificial Sequence; identical to SEQ ID NO: 14145
  neuraminidase__InfluenzaA__AFD63628

SEQ ID NO: 21719 - protein, 469 aa, Artificial Sequence; identical to SEQ ID NO: 14225
  neuraminidase__InfluenzaA__AFD63639

SEQ ID NO: 21720 - protein, 469 aa, Artificial Sequence; identical to SEQ ID NO: 14225
  neuraminidase__InfluenzaA__AFD63650

SEQ ID NO: 21721 - protein, 469 aa, Artificial Sequence
  neuraminidase__InfluenzaA__AFD63661
MNPNQKIITIGSVSLTIAAICFLMQIAILVTTVTLHFKQHECNSPPNNQVMLCEPTIIERNITEIVYLTNSTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21722 - protein, 469 aa, Artificial Sequence; identical to SEQ ID NO: 15931
  neuraminidase__InfluenzaA__AFD63672

SEQ ID NO: 21723 - protein, 469 aa, Artificial Sequence
  neuraminidase__InfluenzaA__AFD63683
MNPNQKIITMGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHGRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIIHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21724 - protein, 469 aa, Artificial Sequence
  neuraminidase__InfluenzaA__AFD63694
MNPNQKIITIGSVSLTIATICFLMQIAILVTTITLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21725 - protein, 469 aa, Artificial Sequence
  neuraminidase__InfluenzaA__AFD63705
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGKGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21726 - protein, 469 aa, Artificial Sequence
  neuraminidase__InfluenzaA__AFD63716
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCHQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21727 - protein, 469 aa, Artificial Sequence; identical to SEQ ID NO: 14225
  neuraminidase__InfluenzaA__AFD63727

SEQ ID NO: 21728 - protein, 469 aa, Artificial Sequence; identical to SEQ ID NO: 14225
  neuraminidase__InfluenzaA__AFD63738

SEQ ID NO: 21729 - protein, 469 aa, Artificial Sequence
  neuraminidase__InfluenzaA__AFD63749
MNPNQKIITISSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21730 - protein, 469 aa, Artificial Sequence
  neuraminidase__InfluenzaA__AFD63760
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIIHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21731 - protein, 469 aa, Artificial Sequence; identical to SEQ ID NO: 14225
  neuraminidase__InfluenzaA__AFD63771

SEQ ID NO: 21732 - protein, 469 aa, Artificial Sequence; identical to SEQ ID NO: 14225
  neuraminidase__InfluenzaA__AFD63782

SEQ ID NO: 21733 - protein, 469 aa, Artificial Sequence; identical to SEQ ID NO: 21730
  neuraminidase__InfluenzaA__AFD63793

SEQ ID NO: 21734 - protein, 469 aa, Artificial Sequence; identical to SEQ ID NO: 14225
  neuraminidase__InfluenzaA__AFD63804

SEQ ID NO: 21735 - protein, 469 aa, Artificial Sequence; identical to SEQ ID NO: 14225
  neuraminidase__InfluenzaA__AFD63815

SEQ ID NO: 21736 - protein, 469 aa, Artificial Sequence; identical to SEQ ID NO: 14225
  neuraminidase__InfluenzaA__AFD63826

SEQ ID NO: 21737 - protein, 469 aa, Artificial Sequence; identical to SEQ ID NO: 21730
  neuraminidase__InfluenzaA__AFD63837

SEQ ID NO: 21738 - protein, 469 aa, Artificial Sequence
  neuraminidase__InfluenzaA__AFD63848
MNPNQKIITIGSVSLTIAAICFLMQIAILVTTVTLHFKQRECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEKTEVWWTSNSIVVFCGTSGTYGTGSWPDGADINLMPI

SEQ ID NO: 21739 - protein, 469 aa, Artificial Sequence; identical to SEQ ID NO: 14145
  neuraminidase__InfluenzaA__AFD63859

SEQ ID NO: 21740 - protein, 469 aa, Artificial Sequence; identical to SEQ ID NO: 14145
  neuraminidase__InfluenzaA__AFD63870

SEQ ID NO: 21741 - protein, 469 aa, Artificial Sequence; identical to SEQ ID NO: 14225
  neuraminidase__InfluenzaA__AFD63881

SEQ ID NO: 21742 - protein, 469 aa, Artificial Sequence; identical to SEQ ID NO: 14225
  neuraminidase__InfluenzaA__AFD63892

SEQ ID NO: 21743 - protein, 469 aa, Artificial Sequence
  neuraminidase__InfluenzaA__AFD63903
MNPNQKIITIGSVSLTIAAICFLMQIAILVTTVTLHFKQHECNSPPNNQVMLCEPTIIERNITGIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21744 - protein, 469 aa, Artificial Sequence
  neuraminidase__InfluenzaA__AFD63914
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEKTEVWWTSNSIVVFCGTSGTYGTGSWPDGADINLMPI

SEQ ID NO: 21745 - protein, 469 aa, Artificial Sequence; identical to SEQ ID NO: 21730
  neuraminidase__InfluenzaA__AFD63925

SEQ ID NO: 21746 - protein, 469 aa, Artificial Sequence
  neuraminidase__InfluenzaA__AFD63936
MNPNQKIITIGSVSLTIATICFLMQIAILVTTVTLHFKQHECNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21747 - protein, 469 aa, Artificial Sequence; identical to SEQ ID NO: 14225
  neuraminidase__InfluenzaA__AFD63947

SEQ ID NO: 21748 - protein, 469 aa, Artificial Sequence; identical to SEQ ID NO: 14225
  neuraminidase__InfluenzaA__AFD63958

SEQ ID NO: 21749 - protein, 469 aa, Artificial Sequence; identical to SEQ ID NO: 14225
  neuraminidase__InfluenzaA__AFD63969

SEQ ID NO: 21750 - protein, 469 aa, Artificial Sequence; identical to SEQ ID NO: 14225
  neuraminidase__InfluenzaA__AFD63980

SEQ ID NO: 21751 - protein, 469 aa, Artificial Sequence
  neuraminidase__InfluenzaA__AFD64002
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKTDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21752 - protein, 469 aa, Artificial Sequence; identical to SEQ ID NO: 14135
  neuraminidase__InfluenzaA__AFD64013

SEQ ID NO: 21753 - protein, 469 aa, Artificial Sequence
  neuraminidase__InfluenzaA__AFD64024
MNPNQKIITIGSVSLTIAAICFLMQIAILVTTVTLHFKQHECNSPPNNQVMLCEPTIIEKNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21754 - protein, 469 aa, Artificial Sequence
  neuraminidase__InfluenzaA__AFD64035
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSVVVFCGTSGTYGTGSWPDGADINLMPI

SEQ ID NO: 21755 - protein, 469 aa, Artificial Sequence
  neuraminidase__InfluenzaA__AFD64046
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHERTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21756 - protein, 469 aa, Artificial Sequence; identical to SEQ ID NO: 21730
  neuraminidase__InfluenzaA__AFD64057

SEQ ID NO: 21757 - protein, 469 aa, Artificial Sequence
  neuraminidase__InfluenzaA__AFD64068
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHNRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 21758 - protein, 469 aa, Artificial Sequence
  neuraminidase__InfluenzaA__AFD64079
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRISAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21759 - protein, 469 aa, Artificial Sequence; identical to SEQ ID NO: 14225
  neuraminidase__InfluenzaA__AFD64090

SEQ ID NO: 21760 - protein, 469 aa, Artificial Sequence
  neuraminidase__InfluenzaA__AFD64101
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHGRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21761 - protein, 469 aa, Artificial Sequence
  neuraminidase__InfluenzaA__AFD64112
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIIHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERDNRSGYSGIFSVEGKSCINRCFYVELIRGRKEETEVWWTSNSIVVFCGTSGTYGTGSWPDGADINLMPI

SEQ ID NO: 21762 - protein, 469 aa, Artificial Sequence; identical to SEQ ID NO: 15931
  neuraminidase__InfluenzaA__AFD64123

SEQ ID NO: 21763 - protein, 469 aa, Artificial Sequence; identical to SEQ ID NO: 14225
  neuraminidase__InfluenzaA__AFD64134

SEQ ID NO: 21764 - protein, 469 aa, Artificial Sequence; identical to SEQ ID NO: 14225
  neuraminidase__InfluenzaA__AFD64145

SEQ ID NO: 21765 - protein, 469 aa, Artificial Sequence; identical to SEQ ID NO: 14225
  neuraminidase__InfluenzaA__AFD64156

SEQ ID NO: 21766 - protein, 469 aa, Artificial Sequence; identical to SEQ ID NO: 14145
  neuraminidase__InfluenzaA__AFD64167

SEQ ID NO: 21767 - protein, 469 aa, Artificial Sequence; identical to SEQ ID NO: 14225
  neuraminidase__InfluenzaA__AFD64181

SEQ ID NO: 21768 - protein, 469 aa, Artificial Sequence
  neuraminidase__InfluenzaA__AFD64192
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHVSTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21769 - protein, 469 aa, Artificial Sequence
  neuraminidase__InfluenzaA__AFD64203
MNPNQKIITIGSVSLTIAAICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNRHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTLSEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21770 - protein, 469 aa, Artificial Sequence; identical to SEQ ID NO: 21730
  neuraminidase__InfluenzaA__AFD64214

SEQ ID NO: 21771 - protein, 469 aa, Artificial Sequence; identical to SEQ ID NO: 15929
  neuraminidase__InfluenzaA__AFD64225

SEQ ID NO: 21772 - protein, 469 aa, Artificial Sequence; identical to SEQ ID NO: 14225
  neuraminidase__InfluenzaA__AFD64317

SEQ ID NO: 21773 - protein, 469 aa, Artificial Sequence; identical to SEQ ID NO: 15931
  neuraminidase__InfluenzaA__AFD64328

SEQ ID NO: 21774 - protein, 469 aa, Artificial Sequence; identical to SEQ ID NO: 21730
  neuraminidase__InfluenzaA__AFD64339

SEQ ID NO: 21775 - protein, 469 aa, Artificial Sequence; identical to SEQ ID NO: 14225
  neuraminidase__InfluenzaA__AFD64350

SEQ ID NO: 21776 - protein, 469 aa, Artificial Sequence; identical to SEQ ID NO: 21730
  neuraminidase__InfluenzaA__AFD64361

SEQ ID NO: 21777 - protein, 469 aa, Artificial Sequence; identical to SEQ ID NO: 21730
  neuraminidase__InfluenzaA__AFD64372

SEQ ID NO: 21778 - protein, 469 aa, Artificial Sequence; identical to SEQ ID NO: 14225
  neuraminidase__InfluenzaA__AFD64383

SEQ ID NO: 21779 - protein, 469 aa, Artificial Sequence; identical to SEQ ID NO: 21730
  neuraminidase__InfluenzaA__AFD64394

SEQ ID NO: 21780 - protein, 469 aa, Artificial Sequence; identical to SEQ ID NO: 14225
  neuraminidase__InfluenzaA__AFD64405

SEQ ID NO: 21781 - protein, 469 aa, Artificial Sequence; identical to SEQ ID NO: 14225
  neuraminidase__InfluenzaA__AFD64416

SEQ ID NO: 21782 - protein, 469 aa, Artificial Sequence; identical to SEQ ID NO: 14225
  neuraminidase__InfluenzaA__AFD64427

SEQ ID NO: 21783 - protein, 469 aa, Artificial Sequence
  neuraminidase__InfluenzaA__AFD64438
MNPNQKIITIGSVSLTIAAICFLMQIAILVTTVTLHFKQHECNSPPNNQVMLCEPTIIERNITEIVYLTNTTIEKEICPNLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21784 - protein, 469 aa, Artificial Sequence; identical to SEQ ID NO: 14225
  neuraminidase__InfluenzaA__AFD64449

SEQ ID NO: 21785 - protein, 469 aa, Artificial Sequence; identical to SEQ ID NO: 14145
  neuraminidase__InfluenzaA__AFD64460

SEQ ID NO: 21786 - protein, 469 aa, Artificial Sequence; identical to SEQ ID NO: 21143
  neuraminidase__InfluenzaA__AFD98098

SEQ ID NO: 21787 - protein, 469 aa, Artificial Sequence
  neuraminidase__InfluenzaA__AFD98120
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 21788 - protein, 469 aa, Artificial Sequence; identical to SEQ ID NO: 19518
  neuraminidase__InfluenzaA__AFD98131

SEQ ID NO: 21789 - protein, 469 aa, Artificial Sequence; identical to SEQ ID NO: 21143
  neuraminidase__InfluenzaA__AFD98142

SEQ ID NO: 21790 - protein, 469 aa, Artificial Sequence; identical to SEQ ID NO: 21787
  neuraminidase__InfluenzaA__AFD98164

SEQ ID NO: 21791 - protein, 469 aa, Artificial Sequence
  neuraminidase__InfluenzaA__AFD98175
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVHDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 21792 - protein, 469 aa, Artificial Sequence
  neuraminidase__InfluenzaA__AFD98186
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFVEEGKIVHTSTLSGSAQHVEECSCYPRYPGVRCVCRDNWKGSNRPIVDINIKDHSIISSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21793 - protein, 469 aa, Artificial Sequence; identical to SEQ ID NO: 19518
  neuraminidase__InfluenzaA__AFD98197

SEQ ID NO: 21794 - protein, 469 aa, Artificial Sequence; identical to SEQ ID NO: 20255
  neuraminidase__InfluenzaA__AFD98208

SEQ ID NO: 21795 - protein, 469 aa, Artificial Sequence
  neuraminidase__InfluenzaA__AFD98218
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTIDETSRLGYETFKVIEGWSNPKSKLQINRQVIVDKGNRSGYSGIFSVEGKSCINRCFYVELIRGRKEETEVLWTSNSIVVSCGTSGTYGTGSWPDGADLNLMPI

SEQ ID NO: 21796 - protein, 469 aa, Artificial Sequence; identical to SEQ ID NO: 19518
  neuraminidase__InfluenzaA__AFD98229

SEQ ID NO: 21797 - protein, 469 aa, Artificial Sequence; identical to SEQ ID NO: 19518
  neuraminidase__InfluenzaA__AFD98240

SEQ ID NO: 21798 - protein, 469 aa, Artificial Sequence; identical to SEQ ID NO: 21787
  neuraminidase__InfluenzaA__AFD98251

SEQ ID NO: 21799 - protein, 469 aa, Artificial Sequence; identical to SEQ ID NO: 21787
  neuraminidase__InfluenzaA__AFD98262

SEQ ID NO: 21800 - protein, 469 aa, Artificial Sequence; identical to SEQ ID NO: 20709
  neuraminidase__InfluenzaA__AFD98273

SEQ ID NO: 21801 - protein, 469 aa, Artificial Sequence; identical to SEQ ID NO: 20257
  neuraminidase__InfluenzaA__AFD98283

SEQ ID NO: 21802 - protein, 469 aa, Artificial Sequence; identical to SEQ ID NO: 19518
  neuraminidase__InfluenzaA__AFD98293

SEQ ID NO: 21803 - protein, 469 aa, Artificial Sequence; identical to SEQ ID NO: 20709
  neuraminidase__InfluenzaA__AFD98313

SEQ ID NO: 21804 - protein, 469 aa, Artificial Sequence; identical to SEQ ID NO: 20257
  neuraminidase__InfluenzaA__AFD98323

SEQ ID NO: 21805 - protein, 469 aa, Artificial Sequence; identical to SEQ ID NO: 20709
  neuraminidase__InfluenzaA__AFD98333

SEQ ID NO: 21806 - protein, 469 aa, Artificial Sequence; identical to SEQ ID NO: 21787
  neuraminidase__InfluenzaA__AFD98343

SEQ ID NO: 21807 - protein, 469 aa, Artificial Sequence
  neuraminidase__InfluenzaA__AFD98354
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGNASGKADTKILFIEEGKIVHTSTLLGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 21808 - protein, 469 aa, Artificial Sequence
  neuraminidase__InfluenzaA__AFD98365
MNPNQKIITIGSVSLTISTICFFMQIAILITTVTLHFKQYEFYSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETKVLWTSNSIVVFCGTSGTYGTGSWPDGADLNLMPI

SEQ ID NO: 21809 - protein, 469 aa, Artificial Sequence
  neuraminidase__InfluenzaA__AFD98376
MNPNQKIITIGSVSLTISTICFFMQIAILITTVTLHFKQYEFNFPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 21810 - protein, 469 aa, Artificial Sequence
  neuraminidase__InfluenzaA__AFD98387
MNPNQKIITIGSVSLTISTICFLMQIAILITTVTLHFKQYEFNSPPNNQVMLCEPTIIERNITEIVYLTNTTIEKEICPKLAEYRDWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDRSSNSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21811 - protein, 469 aa, Artificial Sequence
  neuraminidase__InfluenzaA__AFD98398
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTRQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 21812 - protein, 469 aa, Artificial Sequence
  neuraminidase__InfluenzaA__AFD98409
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 21813 - protein, 469 aa, Artificial Sequence; identical to SEQ ID NO: 21787
  neuraminidase__InfluenzaA__AFD98420

SEQ ID NO: 21814 - protein, 469 aa, Artificial Sequence
  neuraminidase__InfluenzaA__AFD98431
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVGRGNRSGYSGIFSVEGKSCINRCFYVELIRGRKEETEVLWTSNSIVVFCGTSGTYGTGSWPDGADLNLMPI

SEQ ID NO: 21815 - protein, 469 aa, Artificial Sequence
  neuraminidase__InfluenzaA__AFD98442
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSGEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFAIKQDIVGINEWSGYSGSFVQHPELTGLDCIRPCFWVELIRGRPKENTIWTSGSSISFCGVNSDTVGWSWPDGAELPFTIDK

SEQ ID NO: 21816 - protein, 469 aa, Artificial Sequence
  neuraminidase__InfluenzaA__AFD98452
MNPNQKIITLGSVSLTISTICFFIQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21817 - protein, 469 aa, Artificial Sequence; identical to SEQ ID NO: 21787
  neuraminidase__InfluenzaA__AFD98463

SEQ ID NO: 21818 - protein, 469 aa, Artificial Sequence
  neuraminidase__InfluenzaA__AFD98474
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 21819 - protein, 469 aa, Artificial Sequence
  neuraminidase__InfluenzaA__AFD98484
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQMNRQVIVDRGNRSGYSGIFSVEGKSCINRCFYVELIRGRKEETEVLWTSNSIVVFCGTSGTYGTGSWPDGADLNLMPI

SEQ ID NO: 21820 - protein, 469 aa, Artificial Sequence
  neuraminidase__InfluenzaA__AFD98495
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKANTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21821 - protein, 469 aa, Artificial Sequence; identical to SEQ ID NO: 21787
  neuraminidase__InfluenzaA__AFD98506

SEQ ID NO: 21822 - protein, 469 aa, Artificial Sequence
  neuraminidase__InfluenzaA__AFD98517
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIKEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21823 - protein, 469 aa, Artificial Sequence; identical to SEQ ID NO: 19518
  neuraminidase__InfluenzaA__AFD98528

SEQ ID NO: 21824 - protein, 469 aa, Artificial Sequence; identical to SEQ ID NO: 21787
  neuraminidase__InfluenzaA__AFD98539

SEQ ID NO: 21825 - protein, 469 aa, Artificial Sequence; identical to SEQ ID NO: 21787
  neuraminidase__InfluenzaA__AFD98550

SEQ ID NO: 21826 - protein, 469 aa, Artificial Sequence
  neuraminidase__InfluenzaA__AFD98561
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCAVVMTDGSASGKADTKILFIEEGKIVHTSTLSGSAQHVEECSCYPRYPGVRCVCRDNWKGSNRPIVDINIKDHSIVSSYVCSGLVGDTPRKSDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21827 - protein, 469 aa, Artificial Sequence
  neuraminidase__InfluenzaA__AFD98572
MNPNQKIITIGSVSLTISTICFFMQIAILITTVTLHFKQYEFNSPPNNQVMLCEPTIIERNITEIVYLTNTTLEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21828 - protein, 469 aa, Artificial Sequence
  neuraminidase__InfluenzaA__AFD98583
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSRDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKSDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21829 - protein, 469 aa, Artificial Sequence
  neuraminidase__InfluenzaA__AFE02944
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLNCIRPCFWVELIRGRPKENTVWTSGSSISFCGVNSDTVGWSWPDGAELPFTIDK

SEQ ID NO: 21830 - protein, 469 aa, Artificial Sequence
  neuraminidase__InfluenzaA__AFE47627
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQTNRQVIVDRGNRSGYSGIFSVESKSCINRCFYVELIRGRKQETEVLWTSNSIVVFCGTSGTYGTGSWPDGADINLMPI

SEQ ID NO: 21831 - protein, 469 aa, Artificial Sequence; identical to SEQ ID NO: 21143
  neuraminidase__InfluenzaA__AFF18509

SEQ ID NO: 21832 - protein, 469 aa, Artificial Sequence
  neuraminidase__InfluenzaA__AFF57129
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWNGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21833 - protein, 469 aa, Artificial Sequence
  neuraminidase__InfluenzaA__AFF57133
MNPNQKIITIGSVCMTIGMANLILQIGNIISIWISHSIQLGNQSQIETCNQSVITYENNTWLNQTYVNISNTNFAAGQSVVSVKLAGNSSLCPVSGWAIYSKDNSIRIGSKGDVFVIREPFISCSPSECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21834 - protein, 469 aa, Artificial Sequence; identical to SEQ ID NO: 16893
  neuraminidase__InfluenzaA__AFF57137

SEQ ID NO: 21835 - protein, 469 aa, Artificial Sequence; identical to SEQ ID NO: 16893
  neuraminidase__InfluenzaA__AFF57141

SEQ ID NO: 21836 - protein, 469 aa, Artificial Sequence; identical to SEQ ID NO: 16893
  neuraminidase__InfluenzaA__AFF57145

SEQ ID NO: 21837 - protein, 469 aa, Artificial Sequence; identical to SEQ ID NO: 16893
  neuraminidase__InfluenzaA__AFF57149

SEQ ID NO: 21838 - protein, 469 aa, Artificial Sequence; identical to SEQ ID NO: 16893
  neuraminidase__InfluenzaA__AFF57153

SEQ ID NO: 21839 - protein, 469 aa, Artificial Sequence; identical to SEQ ID NO: 16893
  neuraminidase__InfluenzaA__AFF57157

SEQ ID NO: 21840 - protein, 469 aa, Artificial Sequence; identical to SEQ ID NO: 16893
  neuraminidase__InfluenzaA__AFF57161

SEQ ID NO: 21841 - protein, 469 aa, Artificial Sequence; identical to SEQ ID NO: 16893
  neuraminidase__InfluenzaA__AFF57165

SEQ ID NO: 21842 - protein, 469 aa, Artificial Sequence; identical to SEQ ID NO: 16893
  neuraminidase__InfluenzaA__AFF57169

SEQ ID NO: 21843 - protein, 469 aa, Artificial Sequence; identical to SEQ ID NO: 16893
  neuraminidase__InfluenzaA__AFF57173

SEQ ID NO: 21844 - protein, 469 aa, Artificial Sequence; identical to SEQ ID NO: 16893
  neuraminidase__InfluenzaA__AFF57177

SEQ ID NO: 21845 - protein, 469 aa, Artificial Sequence; identical to SEQ ID NO: 16893
  neuraminidase__InfluenzaA__AFF57181

SEQ ID NO: 21846 - protein, 469 aa, Artificial Sequence; identical to SEQ ID NO: 16893
  neuraminidase__InfluenzaA__AFF57185

SEQ ID NO: 21847 - protein, 469 aa, Artificial Sequence; identical to SEQ ID NO: 16893
  neuraminidase__InfluenzaA__AFF57189

SEQ ID NO: 21848 - protein, 449 aa, Artificial Sequence
  neuraminidase__InfluenzaA__AFF60789
MNPNKKIITIGSICMVTGMVSLMLQIGNLISIWVSHSIHTGNQHKAEPISNTNFLTEKAVASVKLAGNSSLCPINGWAVYSKDNSIRIGSKGDVFVIREPFISCSHLECRTFFLTQGALLNDKHSNGTVKDRSPHRTLMSCPVGEAPSPYNSRFESVAWSASACHDGTSWLTIGISGPDNGAVAVLKYNGIITDTIKSWRNNILRTQESECACVNGSCFTVMTDGPSNGQASHKIFKMEKGKVVKSVELDAPNYHYEECSCYPDAGEITCVCRDNWHGSNRPWVSFNQNLEYQIGYICSGVFGDNPRPNDGTGSCGPVSSNGAYGVKGFSFKYGNGVWIGRTKSTNSRSGFEMIWDPNGWTETDSSFSVKQDIVAITDWSGYSGSFVQHPELTGLDCIRPCFWVELIRGRPKESTIWTSGSSISFCGVTSDTVGWSWPDGAELPFTIDK

SEQ ID NO: 21849 - protein, 469 aa, Artificial Sequence
  neuraminidase__InfluenzaA__AFG29043
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIRDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21850 - protein, 469 aa, Artificial Sequence; identical to SEQ ID NO: 18519
  neuraminidase__InfluenzaA__AFG29045

SEQ ID NO: 21851 - protein, 469 aa, Artificial Sequence; identical to SEQ ID NO: 18651
  neuraminidase__InfluenzaA__AFG31063

SEQ ID NO: 21852 - protein, 469 aa, Artificial Sequence; identical to SEQ ID NO: 16738
  neuraminidase__InfluenzaA__AFG31073

SEQ ID NO: 21853 - protein, 469 aa, Artificial Sequence
  neuraminidase__InfluenzaA__AFG31083
MNPNQKIITIGSVCMTIGMANLILQIGNIISIWISHSIQLVNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21854 - protein, 469 aa, Artificial Sequence; identical to SEQ ID NO: 16738
  neuraminidase__InfluenzaA__AFG31093

SEQ ID NO: 21855 - protein, 469 aa, Artificial Sequence; identical to SEQ ID NO: 16738
  neuraminidase__InfluenzaA__AFG31103

SEQ ID NO: 21856 - protein, 469 aa, Artificial Sequence; identical to SEQ ID NO: 16738
  neuraminidase__InfluenzaA__AFG31113

SEQ ID NO: 21857 - protein, 469 aa, Artificial Sequence; identical to SEQ ID NO: 16738
  neuraminidase__InfluenzaA__AFG31123

SEQ ID NO: 21858 - protein, 469 aa, Artificial Sequence; identical to SEQ ID NO: 16738
  neuraminidase__InfluenzaA__AFG31133

SEQ ID NO: 21859 - protein, 469 aa, Artificial Sequence; identical to SEQ ID NO: 16738
  neuraminidase__InfluenzaA__AFG31143

SEQ ID NO: 21860 - protein, 469 aa, Artificial Sequence; identical to SEQ ID NO: 16738
  neuraminidase__InfluenzaA__AFG31153

SEQ ID NO: 21861 - protein, 469 aa, Artificial Sequence; identical to SEQ ID NO: 16738
  neuraminidase__InfluenzaA__AFG31163

SEQ ID NO: 21862 - protein, 469 aa, Artificial Sequence
  neuraminidase__InfluenzaA__AFG31173
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGLPKENTIWTSGSSISFCGVNSDTVGWSWPDGAELPFTIDK

SEQ ID NO: 21863 - protein, 469 aa, Artificial Sequence; identical to SEQ ID NO: 21862
  neuraminidase__InfluenzaA__AFG31183

SEQ ID NO: 21864 - protein, 469 aa, Artificial Sequence; identical to SEQ ID NO: 16738
  neuraminidase__InfluenzaA__AFG31193

SEQ ID NO: 21865 - protein, 469 aa, Artificial Sequence; identical to SEQ ID NO: 16738
  neuraminidase__InfluenzaA__AFG31203

SEQ ID NO: 21866 - protein, 469 aa, Artificial Sequence; identical to SEQ ID NO: 16738
  neuraminidase__InfluenzaA__AFG31213

SEQ ID NO: 21867 - protein, 469 aa, Artificial Sequence; identical to SEQ ID NO: 16738
  neuraminidase__InfluenzaA__AFG31223

SEQ ID NO: 21868 - protein, 469 aa, Artificial Sequence; identical to SEQ ID NO: 16738
  neuraminidase__InfluenzaA__AFG31233

SEQ ID NO: 21869 - protein, 469 aa, Artificial Sequence
  neuraminidase__InfluenzaA__AFG31243
MNPNQKIITIGSVCMTIGMANLILQIGNIISIWISHSIQLGNQNQIETCNQSVITYENNTWVNQTYVNISNTNFVAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 21870 - protein, 469 aa, Artificial Sequence; identical to SEQ ID NO: 19730
  neuraminidase__InfluenzaA__AFG31253

SEQ ID NO: 21871 - protein, 469 aa, Artificial Sequence; identical to SEQ ID NO: 16738
  neuraminidase__InfluenzaA__AFG31263

SEQ ID NO: 21872 - protein, 469 aa, Artificial Sequence; identical to SEQ ID NO: 16738
  neuraminidase__InfluenzaA__AFG31273

SEQ ID NO: 21873 - protein, 469 aa, Artificial Sequence; identical to SEQ ID NO: 16738
  neuraminidase__InfluenzaA__AFG31283

SEQ ID NO: 21874 - protein, 469 aa, Artificial Sequence; identical to SEQ ID NO: 16738
  neuraminidase__InfluenzaA__AFG31293

SEQ ID NO: 21875 - protein, 469 aa, Artificial Sequence; identical to SEQ ID NO: 16738
  neuraminidase__InfluenzaA__AFG31303

SEQ ID NO: 21876 - protein, 469 aa, Artificial Sequence; identical to SEQ ID NO: 16738
  neuraminidase__InfluenzaA__AFG31313

SEQ ID NO: 21877 - protein, 469 aa, Artificial Sequence; identical to SEQ ID NO: 16738
  neuraminidase__InfluenzaA__AFG31326

SEQ ID NO: 21878 - protein, 469 aa, Artificial Sequence; identical to SEQ ID NO: 16738
  neuraminidase__InfluenzaA__AFG31336

SEQ ID NO: 21879 - protein, 469 aa, Artificial Sequence; identical to SEQ ID NO: 19730
  neuraminidase__InfluenzaA__AFG31346

SEQ ID NO: 21880 - protein, 469 aa, Artificial Sequence; identical to SEQ ID NO: 19730
  neuraminidase__InfluenzaA__AFG31356

SEQ ID NO: 21881 - protein, 469 aa, Artificial Sequence; identical to SEQ ID NO: 19730
  neuraminidase__InfluenzaA__AFG31366

SEQ ID NO: 21882 - protein, 469 aa, Artificial Sequence; identical to SEQ ID NO: 19730
  neuraminidase__InfluenzaA__AFG31379

SEQ ID NO: 21883 - protein, 469 aa, Artificial Sequence; identical to SEQ ID NO: 19730
  neuraminidase__InfluenzaA__AFG31389

SEQ ID NO: 21884 - protein, 469 aa, Artificial Sequence; identical to SEQ ID NO: 19730
  neuraminidase__InfluenzaA__AFG31399

SEQ ID NO: 21885 - protein, 469 aa, Artificial Sequence; identical to SEQ ID NO: 19730
  neuraminidase__InfluenzaA__AFG31409

SEQ ID NO: 21886 - protein, 469 aa, Artificial Sequence; identical to SEQ ID NO: 16738
  neuraminidase__InfluenzaA__AFG31419

SEQ ID NO: 21887 - protein, 469 aa, Artificial Sequence; identical to SEQ ID NO: 16738
  neuraminidase__InfluenzaA__AFG31429

SEQ ID NO: 21888 - protein, 469 aa, Artificial Sequence; identical to SEQ ID NO: 16738
  neuraminidase__InfluenzaA__AFG31439

SEQ ID NO: 21889 - protein, 469 aa, Artificial Sequence; identical to SEQ ID NO: 16738
  neuraminidase__InfluenzaA__AFG31449

SEQ ID NO: 21890 - protein, 469 aa, Artificial Sequence; identical to SEQ ID NO: 16738
  neuraminidase__InfluenzaA__AFG31459

SEQ ID NO: 21891 - protein, 469 aa, Artificial Sequence; identical to SEQ ID NO: 16738
  neuraminidase__InfluenzaA__AFG31469

SEQ ID NO: 21892 - protein, 469 aa, Artificial Sequence; identical to SEQ ID NO: 16738
  neuraminidase__InfluenzaA__AFG31479

SEQ ID NO: 21893 - protein, 469 aa, Artificial Sequence; identical to SEQ ID NO: 16738
  neuraminidase__InfluenzaA__AFG31499

SEQ ID NO: 21894 - protein, 469 aa, Artificial Sequence; identical to SEQ ID NO: 18629
  neuraminidase__InfluenzaA__AFG31509

SEQ ID NO: 21895 - protein, 469 aa, Artificial Sequence; identical to SEQ ID NO: 19730
  neuraminidase__InfluenzaA__AFG31519

SEQ ID NO: 21896 - protein, 469 aa, Artificial Sequence; identical to SEQ ID NO: 16738
  neuraminidase__InfluenzaA__AFG31529

SEQ ID NO: 21897 - protein, 469 aa, Artificial Sequence; identical to SEQ ID NO: 18629
  neuraminidase__InfluenzaA__AFG31539

SEQ ID NO: 21898 - protein, 469 aa, Artificial Sequence; identical to SEQ ID NO: 16738
  neuraminidase__InfluenzaA__AFG31549

SEQ ID NO: 21899 - protein, 469 aa, Artificial Sequence; identical to SEQ ID NO: 16738
  neuraminidase__InfluenzaA__AFG31559

SEQ ID NO: 21900 - protein, 469 aa, Artificial Sequence; identical to SEQ ID NO: 19730
  neuraminidase__InfluenzaA__AFG31569

SEQ ID NO: 21901 - protein, 469 aa, Artificial Sequence; identical to SEQ ID NO: 16738
  neuraminidase__InfluenzaA__AFG31579

SEQ ID NO: 21902 - protein, 469 aa, Artificial Sequence; identical to SEQ ID NO: 16738
  neuraminidase__InfluenzaA__AFG31589

SEQ ID NO: 21903 - protein, 469 aa, Artificial Sequence; identical to SEQ ID NO: 16738
  neuraminidase__InfluenzaA__AFG31599

SEQ ID NO: 21904 - protein, 469 aa, Artificial Sequence; identical to SEQ ID NO: 16738
  neuraminidase__InfluenzaA__AFG31609

SEQ ID NO: 21905 - protein, 469 aa, Artificial Sequence; identical to SEQ ID NO: 16738
  neuraminidase__InfluenzaA__AFG31619

SEQ ID NO: 21906 - protein, 469 aa, Artificial Sequence; identical to SEQ ID NO: 16738
  neuraminidase__InfluenzaA__AFG31629

SEQ ID NO: 21907 - protein, 469 aa, Artificial Sequence; identical to SEQ ID NO: 19730
  neuraminidase__InfluenzaA__AFG31639

SEQ ID NO: 21908 - protein, 469 aa, Artificial Sequence; identical to SEQ ID NO: 16738
  neuraminidase__InfluenzaA__AFG31649

SEQ ID NO: 21909 - protein, 469 aa, Artificial Sequence; identical to SEQ ID NO: 16738
  neuraminidase__InfluenzaA__AFG31659

SEQ ID NO: 21910 - protein, 469 aa, Artificial Sequence; identical to SEQ ID NO: 16738
  neuraminidase__InfluenzaA__AFG31669

SEQ ID NO: 21911 - protein, 469 aa, Artificial Sequence; identical to SEQ ID NO: 14095
  neuraminidase__InfluenzaA__AFG71868

SEQ ID NO: 21912 - protein, 469 aa, Artificial Sequence; identical to SEQ ID NO: 14095
  neuraminidase__InfluenzaA__AFG71890

SEQ ID NO: 21913 - protein, 469 aa, Artificial Sequence; identical to SEQ ID NO: 14095
  neuraminidase__InfluenzaA__AFG71901

SEQ ID NO: 21914 - protein, 469 aa, Artificial Sequence; identical to SEQ ID NO: 14114
  neuraminidase__InfluenzaA__AFG71912

SEQ ID NO: 21915 - protein, 469 aa, Artificial Sequence
  neuraminidase__InfluenzaA__AFG71934
MNPNQKIITIGSVSLTIATVCFLMQIAILITTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINVKDYSIDSRYVCSGLVGDTPRNNDRFSNSNCRNPNNERGNHGVKGWAFDDGNDVWMGRTISKDSRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 21916 - protein, 469 aa, Artificial Sequence
  neuraminidase__InfluenzaA__AFG71945
MNPNQKIITIGSVSLTIATVCFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDENATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINVKDYSIDSRYVCSGLVGDTPRNNDKSSNSNCRNPNNDKGNHGVKGWAFDDGNDVWMGRTISKDSRSGYETFKVIGGWSTPNSKSQINRQVIVDSDNRSGYSGIFSVEGKSCINRCFYVELIRGREQETKVWWTSNSIVVFCGTSGTYGTGSWPDGADINLMSI

SEQ ID NO: 21917 - protein, 469 aa, Artificial Sequence; identical to SEQ ID NO: 14118
  neuraminidase__InfluenzaA__AFG71967

SEQ ID NO: 21918 - protein, 469 aa, Artificial Sequence; identical to SEQ ID NO: 14118
  neuraminidase__InfluenzaA__AFG71978

SEQ ID NO: 21919 - protein, 469 aa, Artificial Sequence
  neuraminidase__InfluenzaA__AFG71988
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECICINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 21920 - protein, 469 aa, Artificial Sequence; identical to SEQ ID NO: 14118
  neuraminidase__InfluenzaA__AFG71999

SEQ ID NO: 21921 - protein, 469 aa, Artificial Sequence; identical to SEQ ID NO: 14576
  neuraminidase__InfluenzaA__AFG72021

SEQ ID NO: 21922 - protein, 469 aa, Artificial Sequence
  neuraminidase__InfluenzaA__AFG72032
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPYRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 21923 - protein, 469 aa, Artificial Sequence; identical to SEQ ID NO: 14813
  neuraminidase__InfluenzaA__AFG72088

SEQ ID NO: 21924 - protein, 469 aa, Artificial Sequence
  neuraminidase__InfluenzaA__AFG72121
MNPNQKIITIGSVSLTIATICFLMQIAILVTTVTLHFKQYECSSPPNNRVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCMAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETRVWWTSNSIVVFCGTSGTYGTGSWPDGADINLMPI

SEQ ID NO: 21925 - protein, 469 aa, Artificial Sequence
  neuraminidase__InfluenzaA__AFG72143
MNPNQKIITIGSVSLTIATICLLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETKVWWTSNSIVVFCGTSGTYGTGSWPDGADINLMPI

SEQ ID NO: 21926 - protein, 469 aa, Artificial Sequence
  neuraminidase__InfluenzaA__AFG72165
MNPNQKIITIGSVSLTIATICFLMQIAILVTTVTLHFKQYECNSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIVSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQTNRQVIVDRGNRSGYSGIFSVEGKSCINRCFYVELIRGRKQETKVWWTSNSIVVFCGTSGTYGTGSWPDGADINLMPI

SEQ ID NO: 21927 - protein, 469 aa, Artificial Sequence
  neuraminidase__InfluenzaA__AFG72176
MNPNQKIITIGSVSLTIATICFLMQITILVTTVTLHFKQYECNSPPNNQVMLCEPTIIERNITEIVYLTNTTIEKEKCPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSTPNSKLQINRQVIVDRGNRSGYSGIFSVEGKSCINRCFYVELIRGRKQENKVWWTSNSIVVFCGTSGTYGTGSWPDGADINLMPI

SEQ ID NO: 21928 - protein, 469 aa, Artificial Sequence; identical to SEQ ID NO: 21926
  neuraminidase__InfluenzaA__AFG72198

SEQ ID NO: 21929 - protein, 469 aa, Artificial Sequence; identical to SEQ ID NO: 21926
  neuraminidase__InfluenzaA__AFG72209

SEQ ID NO: 21930 - protein, 469 aa, Artificial Sequence
  neuraminidase__InfluenzaA__AFG72220
MNPNQKIITIGSVSLTIATICFLMQIAILVTTVTLHFKQYECNSPPNNQVMLCEPTIIERNITEIVHLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21931 - protein, 469 aa, Artificial Sequence; identical to SEQ ID NO: 21926
  neuraminidase__InfluenzaA__AFG72231

SEQ ID NO: 21932 - protein, 469 aa, Artificial Sequence
  neuraminidase__InfluenzaA__AFG72297
MNPNQKIITIGSVSLTIATICFLMQIAILVTTVTLHFKQYECNSPPNNQVMLCEPTIIERNITEIVYLTNTTIEREICPKLAEYRNWSKPQCKITGFAPFSKDNSIRLSAGGDIWVTREPYVSCDPGKCYQFALGQGTTLNNRHSNDTVHERTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21933 - protein, 469 aa, Artificial Sequence
  neuraminidase__InfluenzaA__AFG72308
MNPNQKIITIGSVSLTIATICFLMQIAILVTTVTLHFKQYECNSPPSNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFRVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21934 - protein, 469 aa, Artificial Sequence; identical to SEQ ID NO: 15185
  neuraminidase__InfluenzaA__AFG72320

SEQ ID NO: 21935 - protein, 469 aa, Artificial Sequence
  neuraminidase__InfluenzaA__AFG72331
MNPNQKIITIGSVSLTVATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21936 - protein, 469 aa, Artificial Sequence
  neuraminidase__InfluenzaA__AFG72353
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDSGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21937 - protein, 469 aa, Artificial Sequence; identical to SEQ ID NO: 15185
  neuraminidase__InfluenzaA__AFG72364

SEQ ID NO: 21938 - protein, 469 aa, Artificial Sequence
  neuraminidase__InfluenzaA__AFG72430
MNPNQKIITIGSVSLTITTICFLMQIAILVITVTLHFKQCECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISQLSGSAQHVEECSCYPRYPGVRCVCRDNWKGSNRPIVDINVKDYSIVSSYVCSGLVGDTPRKNDSSSSSNCLDPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21939 - protein, 469 aa, Artificial Sequence; identical to SEQ ID NO: 15185
  neuraminidase__InfluenzaA__AFG72452

SEQ ID NO: 21940 - protein, 469 aa, Artificial Sequence
  neuraminidase__InfluenzaA__AFG72474
MNPNQKIITIGSVSLTIATICFLMQIAILVTTVTLHFKQYECNSPPNNQVMLCEPTIIERNITEIVYLTNTTIEKEICPKLAEYRNWSKPQCEITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21941 - protein, 469 aa, Artificial Sequence
  neuraminidase__InfluenzaA__AFG72485
MNPNQKIITIGSVSLTIATICFLMQIAILVTTVTLHFKQHECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21942 - protein, 469 aa, Artificial Sequence; identical to SEQ ID NO: 15101
  neuraminidase__InfluenzaA__AFG72507

SEQ ID NO: 21943 - protein, 469 aa, Artificial Sequence
  neuraminidase__InfluenzaA__AFG72529
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCQNPNNENGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21944 - protein, 469 aa, Artificial Sequence
  neuraminidase__InfluenzaA__AFG72540
MNPNQKIITIGSVSLTIATICFLMQIAILVTTVTLHFKQYECNPPPNNQVMLCEPTIIERNITEIVYLTNTTIKKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21945 - protein, 469 aa, Artificial Sequence
  neuraminidase__InfluenzaA__AFG72562
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21946 - protein, 469 aa, Artificial Sequence
  neuraminidase__InfluenzaA__AFG72584
MNPNQKIITIGSVSLTIATICFLMQIAILVTTVTLHFKQYECNSPPNNQVMLCEPTIIERNITEIVYLTNTTIEKEVCPKLAEYRNWSKPQCKITGFAPFSKDNSIRLSAGGDIWVTREPYVSCDPGKCYQFALGQGTTLNNKHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASEKADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21947 - protein, 469 aa, Artificial Sequence
  neuraminidase__InfluenzaA__AFG72606
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDHSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCVNRCFYVELIRGRKQETEVWWTSNSIVVFCGTSGTYGTGSWPDGADINLMPI

SEQ ID NO: 21948 - protein, 469 aa, Artificial Sequence
  neuraminidase__InfluenzaA__AFG72617
MNPNQKIITIGSVSLTITTICFLMQIAILVITVTLHFKQCECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21949 - protein, 469 aa, Artificial Sequence
  neuraminidase__InfluenzaA__AFG72628
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYSGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21950 - protein, 469 aa, Artificial Sequence; identical to SEQ ID NO: 14980
  neuraminidase__InfluenzaA__AFG72639

SEQ ID NO: 21951 - protein, 469 aa, Artificial Sequence
  neuraminidase__InfluenzaA__AFG72650
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCVNRCFYVELIRGRKQETEVWWTSNSIVVFCGTSGTYGTGSWPDGADINLMPI

SEQ ID NO: 21952 - protein, 469 aa, Artificial Sequence; identical to SEQ ID NO: 21949
  neuraminidase__InfluenzaA__AFG72672

SEQ ID NO: 21953 - protein, 468 aa, Artificial Sequence
  neuraminidase__InfluenzaA__AFG72683
MNPNQKIITIGSVSLTIATICFLMQIAILVITVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNEVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21954 - protein, 469 aa, Artificial Sequence
  neuraminidase__InfluenzaA__AFG72705
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISQLSGSAQHVEECSCYPRYPGVRCVCRDNWKGSNRPIVDINVKDHSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21955 - protein, 469 aa, Artificial Sequence
  neuraminidase__InfluenzaA__AFG72716
MNPNQKIITIGSVSLTITTICFLMQIAILVITVTLHFKQCECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLDPNNEEGGHGVKGWAFDDGNDVWMGRTISEKSRSGYETFKVIGGWSKPNSKLQINRQVIVDRGNRSGYSGIFSVEGKSCINRCFYVELIRGRRQETEVWWTSNSIVVFCGTSGTYGTGSWPDGADINLMPI

SEQ ID NO: 21956 - protein, 469 aa, Artificial Sequence
  neuraminidase__InfluenzaA__AFG72738
MNPNQKIITIGSVSLTITTICFLMQIAILVITVTLHFKQCECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISQLSGSAQHVEECSCYPRYPGVRCVCRDNWKGSNRPIVDINVKDYSIVSSYVCSGLVGDTPRKNDSSSSSYCLDPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 21957 - protein, 469 aa, Artificial Sequence; identical to SEQ ID NO: 15185
  neuraminidase__InfluenzaA__AFG72749

SEQ ID NO: 21958 - protein, 469 aa, Artificial Sequence; identical to SEQ ID NO: 14573
  neuraminidase__InfluenzaA__AFG72760

SEQ ID NO: 21959 - protein, 469 aa, Artificial Sequence; identical to SEQ ID NO: 14040
  neuraminidase__InfluenzaA__AFG72771

SEQ ID NO: 21960 - protein, 469 aa, Artificial Sequence
  neuraminidase__InfluenzaA__AFG72782
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIIHTSQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 21961 - protein, 469 aa, Artificial Sequence; identical to SEQ ID NO: 15749
  neuraminidase__InfluenzaA__AFG72793

SEQ ID NO: 21962 - protein, 469 aa, Artificial Sequence; identical to SEQ ID NO: 14284
  neuraminidase__InfluenzaA__AFG72804

SEQ ID NO: 21963 - protein, 469 aa, Artificial Sequence; identical to SEQ ID NO: 15929
  neuraminidase__InfluenzaA__AFG72826

SEQ ID NO: 21964 - protein, 469 aa, Artificial Sequence
  neuraminidase__InfluenzaA__AFG72837
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHERTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21965 - protein, 470 aa, Artificial Sequence
  neuraminidase__InfluenzaA__AFG72848
MNPNQKIITIGSVSLTIATICFLMQIAILVTTVTLHFKQYECNSPPNNQVMLCEPTIIERNITEIVYLTNTTIEKEICPKSAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKYILRTQESECVCINGTCTVVMTDGSASGKADTKILFIEEGKIIHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 21966 - protein, 469 aa, Artificial Sequence
  neuraminidase__InfluenzaA__AFG72859
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDIVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 21967 - protein, 469 aa, Artificial Sequence
  neuraminidase__InfluenzaA__AFG72870
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSTSGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVESKSCINRCFYVELIRGRKEETEVWWTSNSIVVFCGTSGTYGTGSWPDGADINLMPI

SEQ ID NO: 21968 - protein, 469 aa, Artificial Sequence
  neuraminidase__InfluenzaA__AFG72892
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEKTEVLWTSNSIVVFCGTSGTYGTGSWPDGADINLMPI

SEQ ID NO: 21969 - protein, 469 aa, Artificial Sequence
  neuraminidase__InfluenzaA__AFG72903
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKKDSSSSSHCLDPNNEEGGHGVKGWAFDDGNDVWMGRTISEKLRSGYETFKVIEGWSNPNSKLQINRQVIVDRGDRSGYSGIFSVEGKSCINRCFYVELIRGRKEETEVLWTSNSIVVFCGTSGTYGTGSWPDGADINLMPI

SEQ ID NO: 21970 - protein, 469 aa, Artificial Sequence
  neuraminidase__InfluenzaA__AFG72936
MNPNQKIITIGSVSLTISTICFFIQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNIVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21971 - protein, 469 aa, Artificial Sequence
  neuraminidase__InfluenzaA__AFG72958
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNIVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 21972 - protein, 469 aa, Artificial Sequence; identical to SEQ ID NO: 14103
  neuraminidase__InfluenzaA__AFG98811

SEQ ID NO: 21973 - protein, 469 aa, Artificial Sequence
  neuraminidase__InfluenzaA__AFG98822
MNPNQKIITIGSVSLIIATVCFLMQIAILVTTVTLHFKQHECDSPSSNQVMLCEPIIIERNITEIVYLNNTTIEKETCPKLVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPIVDINMKDYSIDSSYVCSGLVGDTPRNDDRSSKSNCRNPNNERGNHGVKGWAFDNGNDVWMGRTISKDLRSGYETFKVIGGWSTPNSKSQINRQVIVDSDNRSGYSGIFSVEGKSCINRCFYVELIRGREQETRVWWTSNSIVVFCGTSGTYGTGSWPDGANINFMPI

SEQ ID NO: 21974 - protein, 469 aa, Artificial Sequence; identical to SEQ ID NO: 20127
  neuraminidase__InfluenzaA__AFG98833

SEQ ID NO: 21975 - protein, 469 aa, Artificial Sequence
  neuraminidase__InfluenzaA__AFG98844
MNPNQKIITIGSVSLTIATICFLMQIAILVTTVTLHFKQYECDSPANNQVMPCEPIIIERNITEIVYLTNTTIEKEMCPKLVEYRNWSKPQCKITGFAPFSKDNSIRLSAGGDIWVTREPYVSCDPGKCYQFALGQGTTLNNRHSNDTIHDRIPHRTLLMNELGVPFHLGTRQVCIAWSSSSCHDGKAWLHVCVTGDDKNATASFIYDGRLVDSIGSWSQNILRTQESECVCINRTCTVVMTDGSASGKADTRILFIEEGKIVHISPLSGSAQHVEECSCYPRYPGVRCICRDNWKGSNRPVVDINVKDYSIDSSYVCSGLVGDTPRNNDRSSSSYCRNPNNERGNHGVKGWAFDDENDVWMGRTISKDSRSGYETFKVIGGWSTPNSKSQINRQVIVDSDNRSGYSGIFSVEGKSCINRCFYVELIRGREQETRVWWTSNSIVVFCGTSGTYGTGSWPDGADINLMPI

SEQ ID NO: 21976 - protein, 469 aa, Artificial Sequence; identical to SEQ ID NO: 14118
  neuraminidase__InfluenzaA__AFG98855

SEQ ID NO: 21977 - protein, 469 aa, Artificial Sequence; identical to SEQ ID NO: 14972
  neuraminidase__InfluenzaA__AFG98866

SEQ ID NO: 21978 - protein, 469 aa, Artificial Sequence
  neuraminidase__InfluenzaA__AFG98877
MNPNQKIITIGSVSLTIATICFLMQIAILVTTVTLHFKQYECDSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 21979 - protein, 469 aa, Artificial Sequence; identical to SEQ ID NO: 14118
  neuraminidase__InfluenzaA__AFG98888

SEQ ID NO: 21980 - protein, 469 aa, Artificial Sequence
  neuraminidase__InfluenzaA__AFG98899
MNPNQKIITIGSVSLIIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 21981 - protein, 469 aa, Artificial Sequence; identical to SEQ ID NO: 14118
  neuraminidase__InfluenzaA__AFG98910

SEQ ID NO: 21982 - protein, 469 aa, Artificial Sequence; identical to SEQ ID NO: 14118
  neuraminidase__InfluenzaA__AFG98921

SEQ ID NO: 21983 - protein, 469 aa, Artificial Sequence
  neuraminidase__InfluenzaA__AFG98932
MNPNQKIITIGSVSLTIATICFLMQIAILVTTVTLHFKQYECDSPANNQVMPCEPIIVERNITEIVYLTNTTIEKEICPKLVEYRKWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 21984 - protein, 469 aa, Artificial Sequence
  neuraminidase__InfluenzaA__AFG98943
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRKNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADIDLMPI

SEQ ID NO: 21985 - protein, 469 aa, Artificial Sequence
  neuraminidase__InfluenzaA__AFG98965
MNPNQKIITIGSVSLTIATICFLMQIAILVTTVTLHFKQYECDSPANNQVMPCEPTIIERNITEIVYLTNITIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSNSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGAGSWPDGADINLMPI

SEQ ID NO: 21986 - protein, 469 aa, Artificial Sequence
  neuraminidase__InfluenzaA__AFG98976
MNPNQKIITIGSVSLTIATICFLMQIAILVTTVTLHFKQYECDSPANNQVMPCEPIIIERNITEIVYLANTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSKNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSSSYCRNPNNEKGNHGVKGWAFDDGNDVWMGRTISEDSRSGYETFKVIGGWSTPNSKLQINRQVIVDSDNRSGYSGVFSVEGKSCINRCFYVELIRGRELETRVWWTSNSIVVFCGTSGTYGTGSWPDGADINLMPI

SEQ ID NO: 21987 - protein, 469 aa, Artificial Sequence; identical to SEQ ID NO: 21986
  neuraminidase__InfluenzaA__AFG98987

SEQ ID NO: 21988 - protein, 469 aa, Artificial Sequence
  neuraminidase__InfluenzaA__AFG98998
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLENKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRKNDRSSSSYCRNPNNEKGNHGVKGWAFDDGNDVWMGRTISEDSRSGYETFKVIGGWSTPNSKLQINRQVIVDSANRSGYSGIFSVEGKSCINRCFYVELIRGREQETRVWWTSNSIVVFCGTSGTYGTGSWPDGADINLMPI

SEQ ID NO: 21989 - protein, 469 aa, Artificial Sequence; identical to SEQ ID NO: 21986
  neuraminidase__InfluenzaA__AFG99009

SEQ ID NO: 21990 - protein, 469 aa, Artificial Sequence
  neuraminidase__InfluenzaA__AFG99020
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHTSPLSGSAQHVEECSCYPRYPGVRCICRDNWKGSNRPVVDINVKDYSIDSSYVCSGLVGDTPRNNDRSSSSYCRNPNNEKGTHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINIMPI

SEQ ID NO: 21991 - protein, 469 aa, Artificial Sequence
  neuraminidase__InfluenzaA__AFG99031
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHTSPLSGSAQHVEECSCYPRYPGVRCICRDNWRGSNRPVVDINVKDYSIDSSYVCSGLVGDTPRNNDRSSSSYCRNPNNEKGTHGVKGWAFDDGNDVWMGRTISEDSRSGYETFKVIGGWSTPNSKLQINRQVIVDSDNRSGYSGIFSVEGKSCINRCFYVELVRGREQETRVWWTSNSIVVFCGTSGTYGTGSWPDGADINLMPI

SEQ ID NO: 21992 - protein, 469 aa, Artificial Sequence; identical to SEQ ID NO: 14576
  neuraminidase__InfluenzaA__AFG99042

SEQ ID NO: 21993 - protein, 469 aa, Artificial Sequence
  neuraminidase__InfluenzaA__AFG99053
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHTSSLSGSAQHVEECSCYPRYPGVRCICRDNWKGSNRPVVDINVKDYSIDSSYVCSGLVGDTPRNNDRSSSSYCRNPNNEKGTHGVKGWAFDDGNDVWMGRTISEDSRSGYETFKVIGGWSIPNSKLQINRQVIVDSDNRSGYSGIFSVEGKSCINRCFYVELIRGREQETRVWWTSNSIVVFCGTSGTYGTGSWPDGADINLMPI

SEQ ID NO: 21994 - protein, 469 aa, Artificial Sequence
  neuraminidase__InfluenzaA__AFG99064
MNPNQKIITIGSVSLTIATVCFLMQIAILVTTVTLHFKQYECDSPPNNQVMPCEPIIIERNVTEIVYLTNTTIEKEICPKLVEYRNWSKPQCKITGFAPFSKDNSIRLSAGGDIWVTREPYVSCDPSKCYQFALGQGTTLDNKHSNDTIHDRTPHRTLLMNELGVPFHLGTRQVCIAWSSSSCHDGKAWLHVCITGYDKNATASFIYDGRLVDSIGSWSKNILRTQESECVCINGTCTVVMTDGSASERADTKILFIEEGKIVHISPLSGSAQHVEECSCYPRYPGVRCICRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 21995 - protein, 469 aa, Artificial Sequence
  neuraminidase__InfluenzaA__AFG99086
MNPNQKIITIGSVSLTIATICFLMQIAILVTTVTLHFKQYECDSPANNQVMPCEPIIIERNVTEIVYLTNTTIEKEICPKLVEYRNWSKPQCKITGFAPFSKDNSIRLSAGGDIWVTREPYVSCDPGKCYQFALGQGTTLDNKHSNDTIHDRTPYRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIVHISPLSGSAQHVEECSCYPRYPGVRCICRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 21996 - protein, 469 aa, Artificial Sequence
  neuraminidase__InfluenzaA__AFG99097
MNPNQKIITIGSVSLTIATICFLMQIAILVTTVTLHFKQYECDSPANNQVMPCEPIIIERNVTEIVYLTNTTIEKEICPKLVEYRNWSKPQCKITGFAPFSKDNSIRLSAGGDIWVTREPYVSCDPGKCYQFALGQGTTLDNKHSNDTIHDRTPYRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIVHISPLSGSAQHVEECSCYPRYPGVRCICRDNWKGSNRPVVDINVKDYSIVSSYVCSGLVGDTPRKNDRSSSSYCRNPNNEKGNHGVKGWAFDDGNDVWMGRTISEESRLGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 21997 - protein, 469 aa, Artificial Sequence
  neuraminidase__InfluenzaA__AFG99119
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPYRTLLMNELGVPFHLGTRQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 21998 - protein, 469 aa, Artificial Sequence
  neuraminidase__InfluenzaA__AFG99130
MNPNQKIITIGSVSLTIATICFLMQIAILVTTVTLHFKQYECSSPPNNQVMPCGPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPYRTLLMNELGVPFHLGTRQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKLQTNRQVIVDSDNRSGYSGIFSVEGKSCINRCFYVELIRGREQETRVWWTSNSIVVFCGTSGTYGTGSWPDGADINLMPI

SEQ ID NO: 21999 - protein, 469 aa, Artificial Sequence
  neuraminidase__InfluenzaA__AFG99141
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPYRTLLMNELGVPFHLGTRQVCIAWSSSSCHDGKAWLHVCVTGHDKNATASFIYDGRLVDSIGSWSKNILRTQESECVCINGTCTVVMTDGSASERAETKILFIEEGKIVHISPLSGSAQHVEECSCYPRYPGVRCVCRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 22000 - protein, 469 aa, Artificial Sequence
  neuraminidase__InfluenzaA__AFG99152
MNPNQKIMTIGSVSLTIATICFLMQIAILVTTVTLHFKHYEFSSPPNNQVMPCEPIIIERNITEIVYLTNTTIEKEVCPKLVEYRNWSKPQCKITGFAPFSKDNSIRLSAGGDIWVTREPYVSCDPGKCYQFALGQGTTLNNKHSNDTIHDRTPYRTLLMNELGVPFHLGTRQVCIAWSSSSCHDGKAWLHVCVTGHDKNATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGNHGVKGWAFDDGNDVWMGRTIGEELRSGYETFKVIGGWSTPNSKLQINRQVIVDSDNRSGYSGIFSVEGKSCINRCFYVELIRGREQETRVLWTSNSIVVFCGTSGTYGTGSWPDGADINLMPI

SEQ ID NO: 22001 - protein, 469 aa, Artificial Sequence; identical to SEQ ID NO: 18995
  neuraminidase__InfluenzaA__AFG99163

SEQ ID NO: 22002 - protein, 469 aa, Artificial Sequence
  neuraminidase__InfluenzaA__AFG99174
MNPSQKIITIGSVSLTIATICFLMQIAILVTTVTLHFKQYECSSPPNNQVMPCEPIIIERNITEIVYLTNTTIEKEICPKLMEYRNWSKPQCKITGFAPFSKDNSIRLSAGGDIWVTREPYVSCDPGKCYQFALGQGTTLDNKHSNDTIHDRTPYRTLLMNELGVPFHLGTRQVCIAWSSSSCHDGKAWLHVCVTGHDKNATASFIYDGRLVDSIGSWSKNILRTQESECVCINGTCTVVMTDGSASERAETKILFIEEGKIVHISPLSGSAQHVEECSCYPRYPGVRCVCRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 22003 - protein, 469 aa, Artificial Sequence
  neuraminidase__InfluenzaA__AFG99185
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLNNKHSNDTIHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGNHGVKGWAFDDGNDVWMGRTIGEELRSGYETFKVIGGWSTPNSKLQINRQVIVDSKNRSGYSGIFSVEGKSCINRCFYVELIRGREQETRVWWTSNSIVVFCGTSGTYGTGSWPDGADINLMPI

SEQ ID NO: 22004 - protein, 469 aa, Artificial Sequence
  neuraminidase__InfluenzaA__AFG99196
MNPNQKIITIGSVSLTIATICFLTQIAILVTTVTLHFKQYECSSSPNNQVMPCEPIIIERNITEIVYLTNTTIEKEICPKLVEYRNWSKPQCKITGFAPFSKDNSIRLSAGGDIWVTREPYVSCDPGKCYQFALGQGTTLNNKHSNDTIHDRTPYRTLLMNELGVPFHLGTKQVCIAWSSSSCHDGKAWLHVCITGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGNHGVKGWAFDDGNDVWMGRTIGEELRSGYETFKVIGGWSTPNSKLQINRQVIVDSGNRSGYSGIFSVEGKSCINRCFYVELIRGREQETRVWWTSNSIVVFCGTSGTYGTGSWPDGADINLMPI

SEQ ID NO: 22005 - protein, 469 aa, Artificial Sequence
  neuraminidase__InfluenzaA__AFG99207
MNPNQKIITIGSVSLTIATICFLMQIAILVTTVTLHFKPYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLNNKHSNDTIHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGNHGVKGWAFDDGNDVWMGRTIGEELRSGYETFKVIGGWSTPNSKLQINRQVIVDSKSRSGYSGIFSVEGKSCINRCFYVELIRGREQETRVWWTSNSIVVFCGTSGTYGTGSWPDGADINLMPI

SEQ ID NO: 22006 - protein, 469 aa, Artificial Sequence; identical to SEQ ID NO: 14814
  neuraminidase__InfluenzaA__AFG99218

SEQ ID NO: 22007 - protein, 469 aa, Artificial Sequence
  neuraminidase__InfluenzaA__AFG99229
MNPNQKIITIGSVSLTIATICFLMQIAILVTTVTLHFKQYECSSPPNNQVMPCEPIIIERNITKIVYLTNTTIEKEICPKLVEYRNWSKPQCKITGFAPFSKDNSIRLSAGGDIWVTREPYVSCDPGKCYQFALGQGTTLNNKHSNDTIHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGNHGVKGWAFDDGNDVWMGRTIGEELRSGYETFKVIGGWSTPNSKLQINRQVIVDSKNRSGYSGIFSVEGKSCINRCFYVELIRGREQETRVWWTSNSIVVFCGTSGTYGTGSWPDGADINLMPI

SEQ ID NO: 22008 - protein, 469 aa, Artificial Sequence
  neuraminidase__InfluenzaA__AFG99240
MNPNQKIITIGSVSLTIATICFLMQIAILVTTVTLHFKQYECSSPPSNQVMPCEPIIIERNITEIVYLTNTTIEKEICPKPVEYRNWSKPQCKITGFAPFSKDNSIRLSAGGDIWVTREPYVSCDPGKCYQFALGQGTTLNNKHSNDTIHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRFSSSYCRNPNNEKGNHGVKGWAFDDGNDVWMGRTIGEELRSGYETFKVIGGWSTPNSKLQINRQVIVDSKNRSGYSGIFSVEGKSCINRCFYVELIRGREQETRVWWTSNSIVVFCGTSGTYGTGSWPDGADINLMPI

SEQ ID NO: 22009 - protein, 469 aa, Artificial Sequence; identical to SEQ ID NO: 14813
  neuraminidase__InfluenzaA__AFG99251

SEQ ID NO: 22010 - protein, 469 aa, Artificial Sequence
  neuraminidase__InfluenzaA__AFG99273
MNPNQKIITIGSVSLTIATMCFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGREQETRVWWTSNSIVVFCGTSGTYGTGSWPDGADINLMPI

SEQ ID NO: 22011 - protein, 469 aa, Artificial Sequence
  neuraminidase__InfluenzaA__AFG99284
MNPNQKIITIGSVSLTIATICFLMQIAILVTTVTLHFKQYECSSPPSNQVMPCEPIIIERNITKIVYLTNTTIEKEICPKLVEYRNWSKPQCKITGFAPFSKDNSIRLSAGGDIWVTREPYVSCDPSKCYQFALGQGTTLNNKHSNDTIHDRTPYRTLLMNELGVPFHLGTKQVCIAWSSSSCHDGKAWLHVCVTGHDDNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSKNRSGYSGIFSVEGKSCINRCFYVELIRGREQETRVWWTSNSIVVFCGTSGTYGTGSWPDGADINLMPI

SEQ ID NO: 22012 - protein, 469 aa, Artificial Sequence
  neuraminidase__InfluenzaA__AFG99295
MNPNQKIITIGSVSLTIATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDKNATASFIYNGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIISSYVCSGLVGDTPRKNDRSSSSYCQNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETRVWWTSNSIVVFCGTSGTYGTGSWPDGADINLMPI

SEQ ID NO: 22013 - protein, 469 aa, Artificial Sequence
  neuraminidase__InfluenzaA__AFG99317
MNPNQKIITIGSVSLTIATICFLMQIAILVTTVTLHFKQYECSSPPNNQVMPCEPTIIERNITEIVYLTNTTIEKEICPKLVEYRNWSKPQCNITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIDEELRSGYETFKVIGGWSTPNSKLQINRQVIVDSGNRSGYSGIFSVEGKSCINRCFYVELIRGRKQETRVWWTSNSIVVFCGTSGTYGTGSWPDGADINLMPI

SEQ ID NO: 22014 - protein, 469 aa, Artificial Sequence
  neuraminidase__InfluenzaA__AFG99328
MNPNQKIITIGSVSLTLATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPSKCYQFALGQGTTLNNRHSNDTVHDRTPYRTLLMNELGVPFHLGTRQVCMAWSSSSCHDGKAWLHVCVTGHDENATASFIYDGRLVDSIGSWSKNVLRTQESECVCINGTCTVVMTDGSASERADTKILFIEEGKIVHISPLSGNAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETRVWWTSNSIVVFCGTSGTYGTGSWPDGADINLMPI

SEQ ID NO: 22015 - protein, 469 aa, Artificial Sequence
  neuraminidase__InfluenzaA__AFG99350
MNPNQKIITIGSVSLTLATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPSKCYQFALGQGTTLNNRHSNDTVHDRTPYRTLLMNELGVPFHLGTRQVCMAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETRVWWTSNSIVVFCGTSGTYGTGSWPDGADINLMPI

SEQ ID NO: 22016 - protein, 469 aa, Artificial Sequence
  neuraminidase__InfluenzaA__AFG99361
MNPNQKIITIGSVSLTIATICFLMQIAILVTTVTLHFKQYECNSPPNNQVMLCEPTIIERNITEIVYLTNTTIEKEKCPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22017 - protein, 469 aa, Artificial Sequence
  neuraminidase__InfluenzaA__AFG99383
MNPNQKIITIGSVSLTIATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETKVWWTSNSIVVFCGTSGTYGTGSWPDGADINLMPI

SEQ ID NO: 22018 - protein, 469 aa, Artificial Sequence; identical to SEQ ID NO: 22017
  neuraminidase__InfluenzaA__AFG99394

SEQ ID NO: 22019 - protein, 469 aa, Artificial Sequence
  neuraminidase__InfluenzaA__AFG99405
MNPNQKIITIGSVSLTIATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIISSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGREQETRVWWTSNSIVVFCGTSGTYGTGSWPDGADINLMPI

SEQ ID NO: 22020 - protein, 469 aa, Artificial Sequence
  neuraminidase__InfluenzaA__AFG99416
MNPNQKIITIGSVSLTIATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIIHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQINRQVIVDGGNRSGYSGIFSVEGKSCINRCFYVELIRGRKQETKVWWTSNSIVVFCGTSGTYGTGSWPDGADINLMPI

SEQ ID NO: 22021 - protein, 469 aa, Artificial Sequence
  neuraminidase__InfluenzaA__AFG99427
MNPNQKIITIGSVSLTIATICFLMQIAILVTTVTLHFKQYECSSPPNNQVMPCEPTIIERNITEIVYLTNTTIEKEVCPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIIHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETKVWWTSNSIVVFCGTSGTYGTGSWPDGADINLMPI

SEQ ID NO: 22022 - protein, 469 aa, Artificial Sequence
  neuraminidase__InfluenzaA__AFG99438
MNPNQKIITIGSVSLTIATICFLMQIAILVTTVTLHFRQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCMAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETRVWWTSNSIVVFCGTSGTYGTGSWPDGADINLMPI

SEQ ID NO: 22023 - protein, 469 aa, Artificial Sequence
  neuraminidase__InfluenzaA__AFG99449
MNPNQKIITIGSVSLTIATICFLMQIAILVTTVTLHFRQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCMAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKNCINRCFYVELIRGRKQETRVWWTSNSIVVFCGTSGTYGTGSWPDGADINLMPI

SEQ ID NO: 22024 - protein, 469 aa, Artificial Sequence
  neuraminidase__InfluenzaA__AFG99471
MNPNQKIITIGSVSLILATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRNPYRTLLMNELGVPFHLGTRQVCMAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETRVWWTSNSIVVFCGTSGTYGTGSWPDGADINLMPI

SEQ ID NO: 22025 - protein, 469 aa, Artificial Sequence
  neuraminidase__InfluenzaA__AFG99482
MNPNQKIITIGSVSLTIATICFLMQIAILVTTVTLHFKQYECNSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQINRQVIVDRGNRSGYSGIFSVEGKNCINRCFYVELIRGRKQETKVWWTSNSIVVFCGTSGTYGTGSWPDGADINLMSI

SEQ ID NO: 22026 - protein, 469 aa, Artificial Sequence
  neuraminidase__InfluenzaA__AFG99493
MNPNQKIITIGSVSLTIATICFLMQIAILVTTVTLHFKQYECNSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQINRQVIVDRGNRSGYSGIFSVEGKSCINRCFYVELIRGRKQETKVWWTSNSIVVFCGTSGTYGTGSWPDGADINLMPI

SEQ ID NO: 22027 - protein, 469 aa, Artificial Sequence
  neuraminidase__InfluenzaA__AFG99504
MNPNQKIITIGSVSLTIATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETRVWWTSNSIVVFCGTSGTYGTGSWPDGADINLMPI

SEQ ID NO: 22028 - protein, 469 aa, Artificial Sequence
  neuraminidase__InfluenzaA__AFG99515
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22029 - protein, 469 aa, Artificial Sequence
  neuraminidase__InfluenzaA__AFG99526
MNPNQKIITIGSVSLTLATICFLMQIAILVTTVTLHFKQYECSSPPNNQVMPCEPTIIERNITEIVYLTNTTIEKEVCPKLVEYRNWSKPQCKITGFAPFSKDNSIRLSAGGDIWVTREPYVSCDPGKCYQFALGQGTTLNNRHSNDTVHDRTPYRTLLMNELGVPFHLGTRQVCMAWSSSSCHDGKAWLHVCVTGHDENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRKQETRVWWTSNSIVVFCGTSGTYGTGSWPDGADINLMPI

SEQ ID NO: 22030 - protein, 469 aa, Artificial Sequence; identical to SEQ ID NO: 21926
  neuraminidase__InfluenzaA__AFG99537

SEQ ID NO: 22031 - protein, 469 aa, Artificial Sequence; identical to SEQ ID NO: 21926
  neuraminidase__InfluenzaA__AFG99548

SEQ ID NO: 22032 - protein, 469 aa, Artificial Sequence; identical to SEQ ID NO: 21926
  neuraminidase__InfluenzaA__AFG99559

SEQ ID NO: 22033 - protein, 469 aa, Artificial Sequence; identical to SEQ ID NO: 21926
  neuraminidase__InfluenzaA__AFG99570

SEQ ID NO: 22034 - protein, 469 aa, Artificial Sequence; identical to SEQ ID NO: 21926
  neuraminidase__InfluenzaA__AFG99581

SEQ ID NO: 22035 - protein, 469 aa, Artificial Sequence
  neuraminidase__InfluenzaA__AFG99592
MNPNQKIITIGSVSLTIATTCFLMQIAILVTTVTLHFKQYECNSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIVSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQTNRQVIVDRGNRSGYSGIFSVEGKSCINRCFYVELIRGRKQETKVWWTSNSIVVFCGTSGTYGTGSWPDGADINLMPI

SEQ ID NO: 22036 - protein, 469 aa, Artificial Sequence; identical to SEQ ID NO: 21926
  neuraminidase__InfluenzaA__AFG99603

SEQ ID NO: 22037 - protein, 469 aa, Artificial Sequence; identical to SEQ ID NO: 21926
  neuraminidase__InfluenzaA__AFG99614

SEQ ID NO: 22038 - protein, 469 aa, Artificial Sequence; identical to SEQ ID NO: 21926
  neuraminidase__InfluenzaA__AFG99625

SEQ ID NO: 22039 - protein, 469 aa, Artificial Sequence
  neuraminidase__InfluenzaA__AFG99636
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIVSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEDLRSGYETFKVIGGWSTPNSKLQTNRQVIVDRGNRSGYSGIFSVEGKSCINRCFYVELIRGRKQETKVWWTSNSIVVFCGTSGTYGTGSWPDGADINLMPI

SEQ ID NO: 22040 - protein, 469 aa, Artificial Sequence
  neuraminidase__InfluenzaA__AFG99658
MNPNQKIITIGSVSLTIATICFLMQITILVTTVTLHFKQYECNSPPNNQVMLCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSISSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSTPNSKLQINRQVIVDRGNRSGYSGIFSVEGKSCINRCFYVELIRGRKQENKVWWTSNSIVVFCGTSGTYGTGSWPDGADINLMPI

SEQ ID NO: 22041 - protein, 469 aa, Artificial Sequence
  neuraminidase__InfluenzaA__AFG99680
MNPNQKIITIGSVSLTIATICFLMQIAILVTTVTLHFKQYECSSPPNNQVILCQPTIIERNITEIVYLTNTTIEKEICPKLVEYRNWSKPQCKITGFAPFSKDNSIRLSAGGDIWVTREPYVSCDPSKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKVVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSTPNSKLQINRQVIVDSGNRSGYSGIFSVEGKSCINRCFYVELIRGRKQETKVWWTSNSIVVFCGTSGTYGTGSWPDGADINLMPI

SEQ ID NO: 22042 - protein, 469 aa, Artificial Sequence
  neuraminidase__InfluenzaA__AFG99691
MNPNQKIITIGSVSLTIATICFLMQIAILVTTVTLHFKQYECNSPPNNQVMPCEPTIIERNTTEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIVSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQTNRQVIVDRGNRSGYSGIFSVEGKSCINRCFYVELIRGRKQETKVWWTSNSIVVFCGTSGTYGTGSWPDGADINLMPI

SEQ ID NO: 22043 - protein, 469 aa, Artificial Sequence; identical to SEQ ID NO: 21926
  neuraminidase__InfluenzaA__AFG99704

SEQ ID NO: 22044 - protein, 469 aa, Artificial Sequence; identical to SEQ ID NO: 21926
  neuraminidase__InfluenzaA__AFG99715

SEQ ID NO: 22045 - protein, 469 aa, Artificial Sequence; identical to SEQ ID NO: 21926
  neuraminidase__InfluenzaA__AFG99726

SEQ ID NO: 22046 - protein, 469 aa, Artificial Sequence
  neuraminidase__InfluenzaA__AFG99737
MNPNQKIITIGSVSLTIATICFLMQITILVTTVTLHFKQYECNSPPNNQVMLCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSTPNSKLQINRQVIVDRGNRSGYSGIFSVEGKSCINRCFYVELIRGRKQENKVWWTSNSIVVFCGTSGTYGTGSWPDGADINLMPI

SEQ ID NO: 22047 - protein, 469 aa, Artificial Sequence
  neuraminidase__InfluenzaA__AFG99748
MNPNQKIITIGSVSLTIATICFLMQIAILVTTVTLHFKQYDCNSPPNNQAMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQINRQVIVDRGNRSGYSGIFSVEGKSCTNRCFYVELIRGRKQETEVWWTSNSIVVFCGTSGTYGTGSWPDGADINLMPI

SEQ ID NO: 22048 - protein, 469 aa, Artificial Sequence; identical to SEQ ID NO: 21926
  neuraminidase__InfluenzaA__AFG99759

SEQ ID NO: 22049 - protein, 469 aa, Artificial Sequence
  neuraminidase__InfluenzaA__AFG99770
MNPNQKIITIGSVSLTIATICFLMQIAILVTTVTLHFKQYECNSPPNNQIMLCEPTIIERNITEIVYLTNTTIEREICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22050 - protein, 469 aa, Artificial Sequence
  neuraminidase__InfluenzaA__AFG99781
MNPNQKIITIGSVSLTIATICFLMQIAILVTTVTLHFKQYECSSPPNNQVMLCQPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASKRADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSTPNSKLQTNRQVIVDSGNRSGYSGIFSVEGKSCINRCFYVELIRGRKQETKVWWTSNSIVVFCGTSGTYGTGSWPDGADINLMPI

SEQ ID NO: 22051 - protein, 469 aa, Artificial Sequence; identical to SEQ ID NO: 21926
  neuraminidase__InfluenzaA__AFG99792

SEQ ID NO: 22052 - protein, 469 aa, Artificial Sequence; identical to SEQ ID NO: 22046
  neuraminidase__InfluenzaA__AFG99803

SEQ ID NO: 22053 - protein, 469 aa, Artificial Sequence; identical to SEQ ID NO: 21926
  neuraminidase__InfluenzaA__AFG99825

SEQ ID NO: 22054 - protein, 469 aa, Artificial Sequence; identical to SEQ ID NO: 21926
  neuraminidase__InfluenzaA__AFG99836

SEQ ID NO: 22055 - protein, 469 aa, Artificial Sequence; identical to SEQ ID NO: 21926
  neuraminidase__InfluenzaA__AFG99847

SEQ ID NO: 22056 - protein, 469 aa, Artificial Sequence; identical to SEQ ID NO: 21926
  neuraminidase__InfluenzaA__AFG99858

SEQ ID NO: 22057 - protein, 469 aa, Artificial Sequence; identical to SEQ ID NO: 21926
  neuraminidase__InfluenzaA__AFG99869

SEQ ID NO: 22058 - protein, 469 aa, Artificial Sequence; identical to SEQ ID NO: 21926
  neuraminidase__InfluenzaA__AFG99880

SEQ ID NO: 22059 - protein, 469 aa, Artificial Sequence
  neuraminidase__InfluenzaA__AFG99891
MNPNQKIITIGSVSLTIATICFLMQIAILVTTVTLHFKQYECNSPPNNQVMLCEPTIIERNITEIVYFTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISSLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFRVIGGWSTPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22060 - protein, 469 aa, Artificial Sequence; identical to SEQ ID NO: 21926
  neuraminidase__InfluenzaA__AFG99902

SEQ ID NO: 22061 - protein, 469 aa, Artificial Sequence; identical to SEQ ID NO: 21926
  neuraminidase__InfluenzaA__AFG99913

SEQ ID NO: 22062 - protein, 469 aa, Artificial Sequence; identical to SEQ ID NO: 21926
  neuraminidase__InfluenzaA__AFG99924

SEQ ID NO: 22063 - protein, 469 aa, Artificial Sequence
  neuraminidase__InfluenzaA__AFG99935
MNPNQKIITIGSVSLTIATICFLMQIAILVTTVTLHFKQYECNSPPNNQVMLCEPTIVERNITEIVYLTNTTIEKEICPKLAEYRNWSKPQCKITGFAPFSKDNSIRLSAGGDIWVTREPYVSCDPSKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINMKDYSIVSSYVCSGLVGDTPRNNDSSSSSYCRNPNNEKGSHGVKGWAFDDGNDVWMGRTIGEELRSGYETFKVIGGWSTPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22064 - protein, 469 aa, Artificial Sequence; identical to SEQ ID NO: 21926
  neuraminidase__InfluenzaA__AFG99946

SEQ ID NO: 22065 - protein, 469 aa, Artificial Sequence
  neuraminidase__InfluenzaA__AFG99957
MNPNQKIITIGSVSLTIATICFLMQIAILVTTVTLHFKQYECNSPPNNQAMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQINRQVIVDRGNRSGYSGIFSVEGKSCTNRCFYVELIRGRKQETEVWWTSNSIVVFCGTSGTYGTGSWPDGADINLMPI

SEQ ID NO: 22066 - protein, 469 aa, Artificial Sequence; identical to SEQ ID NO: 21926
  neuraminidase__InfluenzaA__AFG99968

SEQ ID NO: 22067 - protein, 469 aa, Artificial Sequence
  neuraminidase__InfluenzaA__AFG99979
MNPNQKIITIGSVSLTIATICFLMQIAILVTTVTLHFKQYECNSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIVSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCLNPNNEKGSHGVKGWAFDDGNDVWMGRTIGEELRSGYETFKVIGGWSTPNSKLQTNRQVIVDRGNRSGYSGIFSVESKSCINRCFYVELIRGRKQETKVWWTSNSIVVFCGTSGTYGTGSWPDGADINLMPI

SEQ ID NO: 22068 - protein, 469 aa, Artificial Sequence
  neuraminidase__InfluenzaA__AFG99990
MNPNQKIITIGSVSLTIATICFLMQIAILVTTVTLHFKQYECNSPPNNQAMLCEPKIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22069 - protein, 469 aa, Artificial Sequence
  neuraminidase__InfluenzaA__AFH00002
MNPNQKIITIGSVSLTIATICFLMQIAILVTTVTLHFKQYECSSPPNNQVIPCQPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCAVVMTDGSASERADTKILFIEEGKVVHISPLSGSAQHVEECSCYPRYPGVRCVCRDNWKGSNRPIVDINVKNYSIVSSYVCSGLVGDTPRKNDSSSSSYCRNPNNEKGSHGVKGWAFDDGNDVWMGRTISEELRSGYETFKVIGGWSTPNSKLQINRQVIVDSGNRSGYSGIFSVEGKSCINRCFYVELIRGRKQETKVWWTSNSIVVFCGTSGTYGTGSWPDGADINLMPI

SEQ ID NO: 22070 - protein, 469 aa, Artificial Sequence; identical to SEQ ID NO: 15185
  neuraminidase__InfluenzaA__AFH00013

SEQ ID NO: 22071 - protein, 469 aa, Artificial Sequence
  neuraminidase__InfluenzaA__AFH00024
MNPNQKIITIGSVSLTIATICFLMQITILVTTVTLHFKQYECNSPPNNQVMLCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGRIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSTPNSKLQINRQVIVDRGNRSGYSGIFSVEGKSCINRCFYVELIRGRKQENKVWWTSNSIVVFCGTSGTYGTGSWPDGADINLMPI

SEQ ID NO: 22072 - protein, 469 aa, Artificial Sequence; identical to SEQ ID NO: 15185
  neuraminidase__InfluenzaA__AFH00035

SEQ ID NO: 22073 - protein, 469 aa, Artificial Sequence; identical to SEQ ID NO: 15185
  neuraminidase__InfluenzaA__AFH00046

SEQ ID NO: 22074 - protein, 469 aa, Artificial Sequence
  neuraminidase__InfluenzaA__AFH00057
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNVLRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSNPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22075 - protein, 469 aa, Artificial Sequence; identical to SEQ ID NO: 15185
  neuraminidase__InfluenzaA__AFH00068

SEQ ID NO: 22076 - protein, 469 aa, Artificial Sequence
  neuraminidase__InfluenzaA__AFH00079
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22077 - protein, 469 aa, Artificial Sequence
  neuraminidase__InfluenzaA__AFH00090
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22078 - protein, 469 aa, Artificial Sequence
  neuraminidase__InfluenzaA__AFH00101
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22079 - protein, 469 aa, Artificial Sequence; identical to SEQ ID NO: 15101
  neuraminidase__InfluenzaA__AFH00112

SEQ ID NO: 22080 - protein, 469 aa, Artificial Sequence; identical to SEQ ID NO: 15101
  neuraminidase__InfluenzaA__AFH00123

SEQ ID NO: 22081 - protein, 469 aa, Artificial Sequence
  neuraminidase__InfluenzaA__AFH00156
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIIDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22082 - protein, 469 aa, Artificial Sequence
  neuraminidase__InfluenzaA__AFH00167
MNPNQKIITIGSVSLTIATMCFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22083 - protein, 469 aa, Artificial Sequence; identical to SEQ ID NO: 22081
  neuraminidase__InfluenzaA__AFH00178

SEQ ID NO: 22084 - protein, 469 aa, Artificial Sequence
  neuraminidase__InfluenzaA__AFH00189
MNPNQKIITIGSVSLTIATICFLMQIAILVTTVTLHFKQYEYNSPPNNQVMLCEPKIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22085 - protein, 469 aa, Artificial Sequence; identical to SEQ ID NO: 15185
  neuraminidase__InfluenzaA__AFH00200

SEQ ID NO: 22086 - protein, 469 aa, Artificial Sequence; identical to SEQ ID NO: 22082
  neuraminidase__InfluenzaA__AFH00211

SEQ ID NO: 22087 - protein, 469 aa, Artificial Sequence
  neuraminidase__InfluenzaA__AFH00222
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNNTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22088 - protein, 469 aa, Artificial Sequence; identical to SEQ ID NO: 15101
  neuraminidase__InfluenzaA__AFH00233

SEQ ID NO: 22089 - protein, 469 aa, Artificial Sequence
  neuraminidase__InfluenzaA__AFH00244
MNPNQKIITIGSVSLTIATICFLMQIAILVTTVTLYFKQYECNSPPSNQVMLCEPTIVERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAKHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22090 - protein, 469 aa, Artificial Sequence; identical to SEQ ID NO: 15185
  neuraminidase__InfluenzaA__AFH00255

SEQ ID NO: 22091 - protein, 469 aa, Artificial Sequence; identical to SEQ ID NO: 15185
  neuraminidase__InfluenzaA__AFH00266

SEQ ID NO: 22092 - protein, 469 aa, Artificial Sequence
  neuraminidase__InfluenzaA__AFH00277
MNPNQKIITIGSVSLTIATICFLMQIAILVTTVTLHFKQYECNSPPSNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRKPNNEKGSHGLKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22093 - protein, 469 aa, Artificial Sequence; identical to SEQ ID NO: 15185
  neuraminidase__InfluenzaA__AFH00288

SEQ ID NO: 22094 - protein, 469 aa, Artificial Sequence; identical to SEQ ID NO: 22017
  neuraminidase__InfluenzaA__AFH00299

SEQ ID NO: 22095 - protein, 469 aa, Artificial Sequence
  neuraminidase__InfluenzaA__AFH00310
MNPNQKIITIGSVSLTIATICFLMQIAILVTTVTLHFKQYECSSSPNNQVIPCQPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASEKADTKILFIEEGKVVHISPLSGSAQHVEECSCYPRYPGVRCVCRDNWKGSNRPIVDINVKNYSIVSSYVCSGLVGDTPRKNDSSSSSYCRNPNNEKGSHGVKGWAFDDGNDVWMGRTISEELRSGYETFKVIGGWSTPNSKLQINRQVIVDSGNRSGYSGIFSVEGKSCINRCFYVELIRGRKQETKVWWTSNSLVVFCGTSGTYGTGSWPDGADINLMPI

SEQ ID NO: 22096 - protein, 469 aa, Artificial Sequence; identical to SEQ ID NO: 22095
  neuraminidase__InfluenzaA__AFH00321

SEQ ID NO: 22097 - protein, 469 aa, Artificial Sequence
  neuraminidase__InfluenzaA__AFH00332
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKGCINRCFYVELIRGRKQETEVWWTSNSIVVFCGTSGTYGTGSWPDGADINLMPI

SEQ ID NO: 22098 - protein, 469 aa, Artificial Sequence
  neuraminidase__InfluenzaA__AFH00343
MNPNQKIITIGSVSLTIATICFLMQIAILVTTVTLHFKQYECNSPPSNQAMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22099 - protein, 469 aa, Artificial Sequence
  neuraminidase__InfluenzaA__AFH00354
MNPNQKIITIGSVSLTIATICFLMQIAILVTTVTLHFKQYECNSPPNNQVMLCEPTIIERNITKIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCVNRCFYVELIRGRKQETEVWWTSNSIVVFCGTSGTYGTGSWPDGADINLMPI

SEQ ID NO: 22100 - protein, 469 aa, Artificial Sequence; identical to SEQ ID NO: 14980
  neuraminidase__InfluenzaA__AFH00365

SEQ ID NO: 22101 - protein, 469 aa, Artificial Sequence
  neuraminidase__InfluenzaA__AFH00376
MNPNQKIITIGSVSLTIATICFLMQIAILVTTVTLHFKQCECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22102 - protein, 469 aa, Artificial Sequence
  neuraminidase__InfluenzaA__AFH00387
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSISSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCVNRCFYVELIRGRKQETEVWWTSNSIVVFCGTSGTYGTGSWPDGADINLMPI

SEQ ID NO: 22103 - protein, 469 aa, Artificial Sequence
  neuraminidase__InfluenzaA__AFH00398
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCVNRCFYVELIRGRKQETEVWWTSNSIVVFCGTSGTYGAGSWPDGADINLMPI

SEQ ID NO: 22104 - protein, 469 aa, Artificial Sequence
  neuraminidase__InfluenzaA__AFH00409
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22105 - protein, 469 aa, Artificial Sequence; identical to SEQ ID NO: 14980
  neuraminidase__InfluenzaA__AFH00420

SEQ ID NO: 22106 - protein, 469 aa, Artificial Sequence; identical to SEQ ID NO: 15113
  neuraminidase__InfluenzaA__AFH00431

SEQ ID NO: 22107 - protein, 469 aa, Artificial Sequence
  neuraminidase__InfluenzaA__AFH00442
MNPNQKIITIGSVSLTIATICFLMQIAILVITVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22108 - protein, 469 aa, Artificial Sequence
  neuraminidase__InfluenzaA__AFH00453
MNPNQKIITIGSVSLTIATICFLMQIAILVTTVTLHFKQYECNSPPNNQVMLCEPTIIERNITEVVYLTNTTIEKEICPKLAEYRNWSKPQCKITGFAPFSKDNSIRLSAGGDIWVTREPYVSCDPDKCYQFALGQGTTLNNRHSNDIVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22109 - protein, 469 aa, Artificial Sequence
  neuraminidase__InfluenzaA__AFH00464
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLKNRHSNDTVHDRTPYRTLLMNELGVPFHLGTKQVCIAWSSSSCHDGKAWLHVCVTGHDENATASFIYGGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22110 - protein, 469 aa, Artificial Sequence
  neuraminidase__InfluenzaA__AFH00475
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCNPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22111 - protein, 469 aa, Artificial Sequence
  neuraminidase__InfluenzaA__AFH00486
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLLGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22112 - protein, 469 aa, Artificial Sequence
  neuraminidase__InfluenzaA__AFH00497
MNPNQKIITIGSVSLTIATICFLMQIAILVTTVTLHFKQYECNSPPNNQVMLCEPTIIERNITEIVYLTNTTIKKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22113 - protein, 469 aa, Artificial Sequence
  neuraminidase__InfluenzaA__AFH00508
MNPNQKIITIGSVSLTIATICFLMQIAILVITVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFRVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22114 - protein, 469 aa, Artificial Sequence
  neuraminidase__InfluenzaA__AFH00519
MNPNQKIITIGSVSLTIATMCFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNGHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22115 - protein, 469 aa, Artificial Sequence; identical to SEQ ID NO: 14573
  neuraminidase__InfluenzaA__AFH00530

SEQ ID NO: 22116 - protein, 469 aa, Artificial Sequence; identical to SEQ ID NO: 14573
  neuraminidase__InfluenzaA__AFH00541

SEQ ID NO: 22117 - protein, 469 aa, Artificial Sequence
  neuraminidase__InfluenzaA__AFH00552
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIIHISQLSGSTQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIEGWSKPNSKLQINRQVIVDRDNRSGYSGIFSVEGKSCINRCFYVELIRGRKQETEVWWTSNSIVVFCGTSGTYGTGSWPDGADINLMPI

SEQ ID NO: 22118 - protein, 469 aa, Artificial Sequence
  neuraminidase__InfluenzaA__AFH00563
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHERTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSPLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 22119 - protein, 469 aa, Artificial Sequence
  neuraminidase__InfluenzaA__AFH00574
MNPNQKIITIGSVSLTIATICFLMQIAILVTTVTLHFKQYECNSPPNNQVMLCEPKIIERNITEIVYLNNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 22120 - protein, 469 aa, Artificial Sequence
  neuraminidase__InfluenzaA__AFH00585
MNPNQKIITIGSVSLTIATICFLMQIAILVTTVTLHFKQYECNSPPNNQVMLCEPTIIERNITEIVYLTNTTIKKEICPKLAEYRNWSKPQCNITGFAPFSKDNSIRLSAGGDIWVTREPYVSCDPDKCYQFALGQGTTLNNRHSNDKVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIKEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKANSKLQINRQVIVDRGNRSGYSGIFSVESKSCINRCFYVELIRGRKQETEVLWTSNSIVVFCGTSGTYGTGSWPDGADINLMPI

SEQ ID NO: 22121 - protein, 469 aa, Artificial Sequence; identical to SEQ ID NO: 14708
  neuraminidase__InfluenzaA__AFH00596

SEQ ID NO: 22122 - protein, 469 aa, Artificial Sequence
  neuraminidase__InfluenzaA__AFH00607
MNPNQKIITIGFVFFTIATICFLMQIAILVTTVTLHFKQYECNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQTNRQVIVERGNRSGYSGIFSVEGKSCINRCFYVELIRGRKEETEVWWTSNSIVVFCGTSGTYGTGSWPDGADINLMPI

SEQ ID NO: 22123 - protein, 469 aa, Artificial Sequence; identical to SEQ ID NO: 15929
  neuraminidase__InfluenzaA__AFH00618

SEQ ID NO: 22124 - protein, 469 aa, Artificial Sequence
  neuraminidase__InfluenzaA__AFH00629
MNPNQKIITIGSVSLTIATICFLMQITILVTTVTLHFKQYECNSPPNNQVMLCEPTIIERNITEIVYLTNTTIEKGICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIIHISTLLGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 22125 - protein, 469 aa, Artificial Sequence; identical to SEQ ID NO: 14327
  neuraminidase__InfluenzaA__AFH00640

SEQ ID NO: 22126 - protein, 469 aa, Artificial Sequence; identical to SEQ ID NO: 16456
  neuraminidase__InfluenzaA__AFH00651

SEQ ID NO: 22127 - protein, 469 aa, Artificial Sequence; identical to SEQ ID NO: 14327
  neuraminidase__InfluenzaA__AFH00662

SEQ ID NO: 22128 - protein, 469 aa, Artificial Sequence
  neuraminidase__InfluenzaA__AFH00673
MNPNQKIITIGSVSLTISTICFFMQIAILITTVTLHFKQYEFSSPPNNQVMLCEPTIIERNITEIVYLTNTTIEKETCPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSRYVCSGLVGDTPRKNDSSSSSHCLDPNNEEGGHGVKGWAFDDGNDVWMGRTISVKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 22129 - protein, 469 aa, Artificial Sequence
  neuraminidase__InfluenzaA__AFH00684
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRERTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22130 - protein, 469 aa, Artificial Sequence
  neuraminidase__InfluenzaA__AFH00695
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRERTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22131 - protein, 469 aa, Artificial Sequence
  neuraminidase__InfluenzaA__AFH00706
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCFDPNNEEGGHGVKGWAFDDGNDVWMGRTISEKSRLGYETFKVIEGWSNPKSKLQINRQVIVDRGDRSGYSGIFSVEGKSCINRCFYVELIRGSKEETEVLWTSNSIVVFCGTSGTYGTGSWPDGADINLMPI

SEQ ID NO: 22132 - protein, 469 aa, Artificial Sequence
  neuraminidase__InfluenzaA__AFH00728
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLNNKHSNDTIHDRTPYRTLLMNELGVPFHLGTRQVCIAWSSSSCHDGKAWLHVCVTGHDKNATASFIYNGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGNHGVKGWAFDDGNDVWMGRTIGEELRSGYETFKVIGGWSTPNSKLQINRQVIVDSDNRSGYSGIFSVEGKSCINRCFYVELIRGREQETRVLWTSNSIVVFCGTSGTYGTGSWPDGADINLMPI

SEQ ID NO: 22133 - protein, 469 aa, Artificial Sequence
  neuraminidase__InfluenzaA__AFH00739
MNPNQKIITIGSVSLTIATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGRGQETRVWWTSNSIVVFCGTSGTYGTGSWPDGADINLMPI

SEQ ID NO: 22134 - protein, 469 aa, Artificial Sequence
  neuraminidase__InfluenzaA__AFH00750
MNPNQKIITIGSVSLTIATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERAYTKILFIKEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVESGNRSGYSGIFSVEGKSCINRCFYVELIRGREQETRVWWTSNSIVVFCGTSGTYGTGSWPDGADINLMPI

SEQ ID NO: 22135 - protein, 469 aa, Artificial Sequence
  neuraminidase__InfluenzaA__AFH00761
MNPNQKIITIGSVSLTIATICFLMQIAILVTTVTLHFKQYECNSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGDDVWMGRTIGEELRSGYETFKVIGGWSTPNSKLQINRQVIVDRGNRSGYSGIFSVEGKSCINRCFYVELIRGRKQETKVWWTSNSIVVFCGTSGTYGTGSWPDGADINLMPI

SEQ ID NO: 22136 - protein, 469 aa, Artificial Sequence
  neuraminidase__InfluenzaA__AFH00783
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGRGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYSGVRCVCRDNWKGSNRPIVDINVKDYSIVSSYVCSGLVGDTPRKNDSSSSSHCLNPNNEEGGHGVKGWAFDDGNDVWMGRTISEKFRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22137 - protein, 469 aa, Artificial Sequence
  neuraminidase__InfluenzaA__AFH00794
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLAAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASERADTKILFIEEGKIVHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGDDVWMGRTISEKLRSGYETFKVIEGWSKPNSKLQTNRQVIVDRGNRSGYSGIFSVEGKSCINRCFYVELIRGRKQETEVWWTSNSIVVFCGTSGTYGTGSWPDGADINLMPI

SEQ ID NO: 22138 - protein, 469 aa, Artificial Sequence; identical to SEQ ID NO: 15488
  neuraminidase__InfluenzaA__AFH00805

SEQ ID NO: 22139 - protein, 469 aa, Artificial Sequence; identical to SEQ ID NO: 19518
  neuraminidase__InfluenzaA__AFH00816

SEQ ID NO: 22140 - protein, 469 aa, Artificial Sequence
  neuraminidase__InfluenzaA__AFH00827
MNPNQKIITIGSVSLTISTTCFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPL

SEQ ID NO: 22141 - protein, 469 aa, Artificial Sequence; identical to SEQ ID NO: 15929
  neuraminidase__InfluenzaA__AFH01410

SEQ ID NO: 22142 - protein, 469 aa, Artificial Sequence
  neuraminidase__InfluenzaA__AFH34942
MNPNQKIITIGSVSLTISTICFFMQIAILITTVTLHFKQYEFNSPPNNQVMLCEPKIIERNITEIVYLTNTTIEKEICPKPAEYRNWSKPQCDITGFAPFSKDNSIRLSAGGDIWVTREPYVSCDPDKCYQFALGQGTTLNNVHSNNTVRNRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22143 - protein, 469 aa, Artificial Sequence
  neuraminidase__InfluenzaA__AFH34956
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRGRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEENEVLWTSNSIVVFCGTSGTYGTGSWPDGADLNLMPI

SEQ ID NO: 22144 - protein, 469 aa, Artificial Sequence
  neuraminidase__InfluenzaA__AFH34963
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNIVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEENEVLWTSNSIVVFCGTSGTYGTGSWPDGADLNLMPI

SEQ ID NO: 22145 - protein, 469 aa, Artificial Sequence
  neuraminidase__InfluenzaA__AFH34970
MNPNQKIITIGSVSLTISTICFFMQIAILITTVTLHFKQYEFNSPPNNQVMLYEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEENEVLWTSNSIVVFCGTSGTYGTGSWPDGADLNLMPI

SEQ ID NO: 22146 - protein, 469 aa, Artificial Sequence
  neuraminidase__InfluenzaA__AFH34977
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22147 - protein, 469 aa, Artificial Sequence
  neuraminidase__InfluenzaA__AFH74468
MNPNQKIITIGSVSLTISTICFFMQTAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGRIVHTSTLSGSAQHVEECSCYPRYPGVRCVCRDNWKGSNRPIVDINIKDHSIVSSYVCSGLVGDTPRKNDSSSSSHCLDPNNEEGDNGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22148 - protein, 469 aa, Artificial Sequence; identical to SEQ ID NO: 18651
  neuraminidase__InfluenzaA__AFH74469

SEQ ID NO: 22149 - protein, 469 aa, Artificial Sequence; identical to SEQ ID NO: 16599
  neuraminidase__InfluenzaA__AFH74480

SEQ ID NO: 22150 - protein, 469 aa, Artificial Sequence; identical to SEQ ID NO: 16599
  neuraminidase__InfluenzaA__AFH74491

SEQ ID NO: 22151 - protein, 469 aa, Artificial Sequence; identical to SEQ ID NO: 21642
  neuraminidase__InfluenzaA__AFH74502

SEQ ID NO: 22152 - protein, 469 aa, Artificial Sequence
  neuraminidase__InfluenzaA__AFH74513
MNPNQKIITIGSVSLTISTICFFMQIAILITTVTLHFKQYEFNSPPNNQVMLCEPTIIERNITEIVYLTNTTIEKETCPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 22153 - protein, 469 aa, Artificial Sequence
  neuraminidase__InfluenzaA__AFH74524
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTINNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSVVVFCGTSGTYGTGSWPDGADINLMPI

SEQ ID NO: 22154 - protein, 469 aa, Artificial Sequence; identical to SEQ ID NO: 16599
  neuraminidase__InfluenzaA__AFH74535

SEQ ID NO: 22155 - protein, 469 aa, Artificial Sequence; identical to SEQ ID NO: 21635
  neuraminidase__InfluenzaA__AFH74546

SEQ ID NO: 22156 - protein, 469 aa, Artificial Sequence; identical to SEQ ID NO: 21635
  neuraminidase__InfluenzaA__AFH74557

SEQ ID NO: 22157 - protein, 469 aa, Artificial Sequence; identical to SEQ ID NO: 21635
  neuraminidase__InfluenzaA__AFH74568

SEQ ID NO: 22158 - protein, 469 aa, Artificial Sequence; identical to SEQ ID NO: 21638
  neuraminidase__InfluenzaA__AFH74579

SEQ ID NO: 22159 - protein, 469 aa, Artificial Sequence
  neuraminidase__InfluenzaA__AFH74590
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMSV

SEQ ID NO: 22160 - protein, 469 aa, Artificial Sequence; identical to SEQ ID NO: 21635
  neuraminidase__InfluenzaA__AFH74601

SEQ ID NO: 22161 - protein, 469 aa, Artificial Sequence
  neuraminidase__InfluenzaA__AFH74612
MNPNQKIITIGSVSLTISTICFFMQTAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLSNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22162 - protein, 469 aa, Artificial Sequence; identical to SEQ ID NO: 21635
  neuraminidase__InfluenzaA__AFH74623

SEQ ID NO: 22163 - protein, 469 aa, Artificial Sequence; identical to SEQ ID NO: 21635
  neuraminidase__InfluenzaA__AFH74634

SEQ ID NO: 22164 - protein, 469 aa, Artificial Sequence; identical to SEQ ID NO: 21642
  neuraminidase__InfluenzaA__AFH74645

SEQ ID NO: 22165 - protein, 469 aa, Artificial Sequence; identical to SEQ ID NO: 21642
  neuraminidase__InfluenzaA__AFH74656

SEQ ID NO: 22166 - protein, 469 aa, Artificial Sequence; identical to SEQ ID NO: 21642
  neuraminidase__InfluenzaA__AFH74667

SEQ ID NO: 22167 - protein, 469 aa, Artificial Sequence; identical to SEQ ID NO: 21642
  neuraminidase__InfluenzaA__AFH74678

SEQ ID NO: 22168 - protein, 469 aa, Artificial Sequence; identical to SEQ ID NO: 16599
  neuraminidase__InfluenzaA__AFH74689

SEQ ID NO: 22169 - protein, 469 aa, Artificial Sequence; identical to SEQ ID NO: 16599
  neuraminidase__InfluenzaA__AFH74700

SEQ ID NO: 22170 - protein, 469 aa, Artificial Sequence
  neuraminidase__InfluenzaA__AFH74711
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPCVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 22171 - protein, 469 aa, Artificial Sequence; identical to SEQ ID NO: 21635
  neuraminidase__InfluenzaA__AFH74722

SEQ ID NO: 22172 - protein, 469 aa, Artificial Sequence; identical to SEQ ID NO: 21635
  neuraminidase__InfluenzaA__AFH74733

SEQ ID NO: 22173 - protein, 469 aa, Artificial Sequence
  neuraminidase__InfluenzaA__AFH74744
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSNYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 22174 - protein, 469 aa, Artificial Sequence; identical to SEQ ID NO: 21635
  neuraminidase__InfluenzaA__AFH74755

SEQ ID NO: 22175 - protein, 469 aa, Artificial Sequence; identical to SEQ ID NO: 21635
  neuraminidase__InfluenzaA__AFH74766

SEQ ID NO: 22176 - protein, 469 aa, Artificial Sequence; identical to SEQ ID NO: 21635
  neuraminidase__InfluenzaA__AFH74777

SEQ ID NO: 22177 - protein, 469 aa, Artificial Sequence; identical to SEQ ID NO: 16599
  neuraminidase__InfluenzaA__AFH74788

SEQ ID NO: 22178 - protein, 469 aa, Artificial Sequence
  neuraminidase__InfluenzaA__AFH74799
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCGPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 22179 - protein, 469 aa, Artificial Sequence; identical to SEQ ID NO: 21655
  neuraminidase__InfluenzaA__AFH74810

SEQ ID NO: 22180 - protein, 469 aa, Artificial Sequence; identical to SEQ ID NO: 21655
  neuraminidase__InfluenzaA__AFH74821

SEQ ID NO: 22181 - protein, 469 aa, Artificial Sequence; identical to SEQ ID NO: 21655
  neuraminidase__InfluenzaA__AFH74832

SEQ ID NO: 22182 - protein, 469 aa, Artificial Sequence; identical to SEQ ID NO: 21655
  neuraminidase__InfluenzaA__AFH74843

SEQ ID NO: 22183 - protein, 469 aa, Artificial Sequence; identical to SEQ ID NO: 21635
  neuraminidase__InfluenzaA__AFH74854

SEQ ID NO: 22184 - protein, 469 aa, Artificial Sequence; identical to SEQ ID NO: 21635
  neuraminidase__InfluenzaA__AFH74865

SEQ ID NO: 22185 - protein, 469 aa, Artificial Sequence; identical to SEQ ID NO: 21635
  neuraminidase__InfluenzaA__AFH74876

SEQ ID NO: 22186 - protein, 469 aa, Artificial Sequence; identical to SEQ ID NO: 21635
  neuraminidase__InfluenzaA__AFH74887

SEQ ID NO: 22187 - protein, 469 aa, Artificial Sequence; identical to SEQ ID NO: 21635
  neuraminidase__InfluenzaA__AFH74898

SEQ ID NO: 22188 - protein, 469 aa, Artificial Sequence; identical to SEQ ID NO: 21635
  neuraminidase__InfluenzaA__AFH74909

SEQ ID NO: 22189 - protein, 469 aa, Artificial Sequence
  neuraminidase__InfluenzaA__AFH74920
MNPNQKIITIGSVSLTISTICFFMQTAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGDHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22190 - protein, 469 aa, Artificial Sequence; identical to SEQ ID NO: 16599
  neuraminidase__InfluenzaA__AFH74931

SEQ ID NO: 22191 - protein, 469 aa, Artificial Sequence; identical to SEQ ID NO: 16599
  neuraminidase__InfluenzaA__AFH74942

SEQ ID NO: 22192 - protein, 469 aa, Artificial Sequence; identical to SEQ ID NO: 21635
  neuraminidase__InfluenzaA__AFH74953

SEQ ID NO: 22193 - protein, 469 aa, Artificial Sequence
  neuraminidase__InfluenzaA__AFH74964
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSILSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 22194 - protein, 469 aa, Artificial Sequence; identical to SEQ ID NO: 21635
  neuraminidase__InfluenzaA__AFH75391

SEQ ID NO: 22195 - protein, 469 aa, Artificial Sequence; identical to SEQ ID NO: 16738
  neuraminidase__InfluenzaA__AFH97143

SEQ ID NO: 22196 - protein, 469 aa, Artificial Sequence
  neuraminidase__InfluenzaA__AFI56407
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGNVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNSFSIKQDIVGINEWSGYSGSFVQHPELTGLDCIRPCFWVELIRGRPKENTIWTSGSSISFCGVNSGTVGWSWPDGAELPFTIDK

SEQ ID NO: 22197 - protein, 469 aa, Artificial Sequence
  neuraminidase__InfluenzaA__AFJ05141
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRSLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22198 - protein, 469 aa, Artificial Sequence
  neuraminidase__InfluenzaA__AFJ05145
MNPNQKIITIGSVSLTMSTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22199 - protein, 469 aa, Artificial Sequence
  neuraminidase__InfluenzaA__AFJ05635
MNPNQKIITIGSVCMTIGMANLILQIGNIISIWISHSIQLRNQSQIETCNQSVITYENNTWVNQTYVNISNTNFAAGQSVVSMKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22200 - protein, 469 aa, Artificial Sequence
  neuraminidase__InfluenzaA__AFJ11709
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMLI

SEQ ID NO: 22201 - protein, 469 aa, Artificial Sequence
  neuraminidase__InfluenzaA__AFJ11720
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLIDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 22202 - protein, 469 aa, Artificial Sequence; identical to SEQ ID NO: 21143
  neuraminidase__InfluenzaA__AFJ11731

SEQ ID NO: 22203 - protein, 469 aa, Artificial Sequence
  neuraminidase__InfluenzaA__AFJ19845
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPDVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 22204 - protein, 469 aa, Artificial Sequence; identical to SEQ ID NO: 16738
  neuraminidase__InfluenzaA__AFJ44697

SEQ ID NO: 22205 - protein, 469 aa, Artificial Sequence; identical to SEQ ID NO: 20257
  neuraminidase__InfluenzaA__AFJ69989

SEQ ID NO: 22206 - protein, 469 aa, Artificial Sequence
  neuraminidase__InfluenzaA__AFJ69990
MNPNQKIITIGSVCMTIGMANLILQIGNITSIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 22207 - protein, 469 aa, Artificial Sequence
  neuraminidase__InfluenzaA__AFJ69991
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNQDLSHSAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22208 - protein, 469 aa, Artificial Sequence; identical to SEQ ID NO: 17564
  neuraminidase__InfluenzaA__AFJ69992

SEQ ID NO: 22209 - protein, 469 aa, Artificial Sequence
  neuraminidase__InfluenzaA__AFJ69993
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVGRGNRSGYSGIFSVEGKSCINRCFYVELIRGRKEETEVLWTSNSIVVFCGTSGTYGTGSWPDGANLNLMPI

SEQ ID NO: 22210 - protein, 469 aa, Artificial Sequence; identical to SEQ ID NO: 19518
  neuraminidase__InfluenzaA__AFJ69994

SEQ ID NO: 22211 - protein, 470 aa, Artificial Sequence
  neuraminidase__InfluenzaA__AFJ74389
MNPNQKIITIGSISIAIGIISLILQIGNIISIWASHSIQTGSQNHTGVCNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDIVAMTDWSGYSGSFVQHPELTGLDCMRPCFWVELVRGLPRENTTIWTSGSSISFCGVNSDTANWSWPDGAELPFTIDK

SEQ ID NO: 22212 - protein, 469 aa, Artificial Sequence
  neuraminidase__InfluenzaA__AFJ74399
MNPNQKIITIGSVSLTIATICFLMQIAILVITLTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDFSIVSSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22213 - protein, 469 aa, Artificial Sequence
  neuraminidase__InfluenzaA__AFJ74410
MNPNQKIITIGSVSLTIATICFLMQIAILVMTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIISSYVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22214 - protein, 469 aa, Artificial Sequence; identical to SEQ ID NO: 14315
  neuraminidase__InfluenzaA__AFJ74451

SEQ ID NO: 22215 - protein, 470 aa, Artificial Sequence
  neuraminidase__InfluenzaA__AFJ74462
MNPNQKIITIGSISVAIGIISLILQIGNIISIWASHSIQTGSQNYTGICNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 22216 - protein, 469 aa, Artificial Sequence
  neuraminidase__InfluenzaA__AFJ74517
MNPNQKIITIGSVSLTIATICFLMQIAILVTTVTLHFKQYECNSPPNNQVMLCEPTIIERNITEIVYMTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQENEVWWTSNSIVVFCGTSGTYGTGSWPDGADINLMPI

SEQ ID NO: 22217 - protein, 469 aa, Artificial Sequence
  neuraminidase__InfluenzaA__AFJ74564
MNPNQKIITIGSVSLTIATICFLMQIAILVTTVTLHFKQYECNSPPNNQVMLCEPTIIERNITEIVYLTNTTTEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISETLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 22218 - protein, 470 aa, Artificial Sequence
  neuraminidase__InfluenzaA__AFJ74639
MNPNQKIITIGSISIAIGIISLMLQIGNIISIWASHSIQTGSQNHTGICNQRIITYENNTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCMNGSCFTIMTDGPSNGAASYKIFKIEKGKVTKSIELNAPSFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 22219 - protein, 469 aa, Artificial Sequence
  neuraminidase__InfluenzaA__AFJ74640
MNPNQKIITIGSVSLTISTICFFMQIAILITTVTLHFKQYEFNSPPNNQVMLCEPTIIERNITEIVYLTNTTIEKEICPKLAGYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDKGNRSGYSGIFSVEGKSCINRCFYVELIRGRKQETEVLWTSNSIVVFCGTSGTYGTGSWPDGADINLMPI

SEQ ID NO: 22220 - protein, 470 aa, Artificial Sequence; identical to SEQ ID NO: 22218
  neuraminidase__InfluenzaA__AFJ74659

SEQ ID NO: 22221 - protein, 470 aa, Artificial Sequence
  neuraminidase__InfluenzaA__AFJ74679
MNPNQKIITIGSISIAIGIISLMLQIGNIISIWASHSIQTGSQNHTGICNQRIITYENNTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCMNGSCFTIMTDGPSNGAASYKIFKIEKGKVTKSIELNAPSFHYEECSCYPDTGTVMCVCRDNWHGSNRPWVSFNQNLDYQIGYICSGVFGDNPRPKDGEGSCNPVTVDGADGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 22222 - protein, 469 aa, Artificial Sequence
  neuraminidase__InfluenzaA__AFJ74680
MNPNQKIITIGSVSLTISTICFFMQIAILITTVTLHFKQYEFNSPPNNQVILCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIKEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 22223 - protein, 469 aa, Artificial Sequence
  neuraminidase__InfluenzaA__AFJ74701
MNPNQKIITIGSVSLTIATICFLMQIAILVTTVTLHFNQYECNSPPNNQVMLCEPTIIERNITEIVYLTNTTIEKEICPKLAEYRIWSKPQCNITGFAPFSKDNSIRLSAGGDIWVTREPYVSCDPDKCYQFALGQGTTLNNGHSNDTVHDRTPYRTLLMNELGVPFHLGTRQVCMAWSSSSCHDGKAWLHVCVTGDDENATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQVNRQVIVERGNRSGYSGIFSVEGKSCINRCFYVELIRGRKEETEVWWTSNSIVVFCGTSGTYGTGSWPDGADINLMPI

SEQ ID NO: 22224 - protein, 469 aa, Artificial Sequence
  neuraminidase__InfluenzaA__AFJ74731
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKTDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRNQETEVLWTSNSIVVFCGTSGTYGTGSWPDGAEINLMPI

SEQ ID NO: 22225 - protein, 470 aa, Artificial Sequence; identical to SEQ ID NO: 22218
  neuraminidase__InfluenzaA__AFJ74766

SEQ ID NO: 22226 - protein, 469 aa, Artificial Sequence
  neuraminidase__InfluenzaA__AFJ74767
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRNQETEVLWTSNSIVVFCGTSGTYGTGSWPDGADINLMPI

SEQ ID NO: 22227 - protein, 469 aa, Artificial Sequence; identical to SEQ ID NO: 22226
  neuraminidase__InfluenzaA__AFJ74783

SEQ ID NO: 22228 - protein, 469 aa, Artificial Sequence; identical to SEQ ID NO: 14145
  neuraminidase__InfluenzaA__AFJ74807

SEQ ID NO: 22229 - protein, 469 aa, Artificial Sequence; identical to SEQ ID NO: 14145
  neuraminidase__InfluenzaA__AFJ74822

SEQ ID NO: 22230 - protein, 469 aa, Artificial Sequence; identical to SEQ ID NO: 14714
  neuraminidase__InfluenzaA__AFJ74834

SEQ ID NO: 22231 - protein, 469 aa, Artificial Sequence; identical to SEQ ID NO: 14145
  neuraminidase__InfluenzaA__AFJ74845

SEQ ID NO: 22232 - protein, 470 aa, Artificial Sequence
  neuraminidase__InfluenzaA__AFJ75039
MNPNQKIITIGSISIAIGIISLMLQIGNIISIWASHSIQTGSQNHTGICNQRIITYENSTWVNNTYVNINNTSVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCMNGSCFTIMTDGPSNGGASYKIFKIEKGKVTKSIELNAPNFHYEECSCYPDTGTVMCVCRDNWHGSNRPWVSFNQNLDYQIGYICSGVFGDNPRPKDGEGSCNPVTIDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 22233 - protein, 469 aa, Artificial Sequence
  neuraminidase__InfluenzaA__AFJ75050
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSVRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIVEGKIVHTSALSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 22234 - protein, 469 aa, Artificial Sequence
  neuraminidase__InfluenzaA__AFJ75094
MNPNQKIITIGSVSLTISTICFFMQIAILITTVTLHFKQYEFNSPPNNQVMLCEPTIIEKNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSNCLDPNNEEGGHGVKGWAFDDGNDVWMGRTISEKSRLGYETFKVIEGWSNPNSKLQINRQVIVDRGNRSGYSGIFSVEGKSCINRCFYVELIRGRKEEIEVLWTSNSIVVFCGTSGTYGTGSWPDGADINIMPI

SEQ ID NO: 22235 - protein, 470 aa, Artificial Sequence
  neuraminidase__InfluenzaA__AFJ75104
MNPNQKIITIGSISIAIGIISLMLQIGNIISIWASHSIQTGSQNHTGICNQRIITYENSTWVNHTYVNINNTNVVAGKDKTPVTLAGNSSLCSISGWAIHTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYNGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPEDGEGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNSDIANWSWPDGAELPFTIDK

SEQ ID NO: 22236 - protein, 469 aa, Artificial Sequence; identical to SEQ ID NO: 15884
  neuraminidase__InfluenzaA__AFJ75114

SEQ ID NO: 22237 - protein, 469 aa, Artificial Sequence; identical to SEQ ID NO: 15884
  neuraminidase__InfluenzaA__AFJ75452

SEQ ID NO: 22238 - protein, 469 aa, Artificial Sequence; identical to SEQ ID NO: 15884
  neuraminidase__InfluenzaA__AFJ75463

SEQ ID NO: 22239 - protein, 470 aa, Artificial Sequence; identical to SEQ ID NO: 22235
  neuraminidase__InfluenzaA__AFJ75552

SEQ ID NO: 22240 - protein, 470 aa, Artificial Sequence
  neuraminidase__InfluenzaA__AFJ75574
MNPNQKIITIGSISIAIGIISLMLQIGNIISIWASHSIQTGSQNHTGICNQRIITYENSTWVNHTYVNINNTNVVAGKDKTPVTLAGNSSLCSISGWAIHTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYNGIITGTIKSWKGQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPEDGEGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNSDIANWSWPDGAELPFTIDK

SEQ ID NO: 22241 - protein, 469 aa, Artificial Sequence; identical to SEQ ID NO: 15884
  neuraminidase__InfluenzaA__AFJ75585

SEQ ID NO: 22242 - protein, 469 aa, Artificial Sequence
  neuraminidase__InfluenzaA__AFJ75596
MNPNQKIITIGSVSLTISTICFFMQTAILITTVTLHFKQYEFNSPPNNQVMLCEPTIIERNITEIVYLTNTTIEKEICPKLAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22243 - protein, 469 aa, Artificial Sequence
  neuraminidase__InfluenzaA__AFJ75607
MNPTQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPEKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSKLSGSAQHVEECSCYPRYPGVRCVCRDNWKGSNRPIVDINIKDHSIVSSYVCSGLVGDTPRKNDSSGSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22244 - protein, 469 aa, Artificial Sequence
  neuraminidase__InfluenzaA__AFJ75633
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKNHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22245 - protein, 470 aa, Artificial Sequence; identical to SEQ ID NO: 17461
  neuraminidase__InfluenzaA__AFJ75654

SEQ ID NO: 22246 - protein, 469 aa, Artificial Sequence; identical to SEQ ID NO: 15884
  neuraminidase__InfluenzaA__AFJ75665

SEQ ID NO: 22247 - protein, 470 aa, Artificial Sequence
  neuraminidase__InfluenzaA__AFJ75676
MNPNQKIITIGSISIAIGIISLMLQIGNIISIWASHSIQTGSQNHTGICNQRIITYENSTWVNHTYVNINNTNVVAGKDKTPVTLAGNSSLCSISGWAIHTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYNGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNSDIANWSWPDGAELPFTIDK

SEQ ID NO: 22248 - protein, 470 aa, Artificial Sequence; identical to SEQ ID NO: 17461
  neuraminidase__InfluenzaA__AFJ75687

SEQ ID NO: 22249 - protein, 469 aa, Artificial Sequence; identical to SEQ ID NO: 16738
  neuraminidase__InfluenzaA__AFJ76122

SEQ ID NO: 22250 - protein, 469 aa, Artificial Sequence; identical to SEQ ID NO: 21316
  neuraminidase__InfluenzaA__AFJ76134

SEQ ID NO: 22251 - protein, 469 aa, Artificial Sequence; identical to SEQ ID NO: 16738
  neuraminidase__InfluenzaA__AFJ76146

SEQ ID NO: 22252 - protein, 469 aa, Artificial Sequence; identical to SEQ ID NO: 16738
  neuraminidase__InfluenzaA__AFJ76159

SEQ ID NO: 22253 - protein, 469 aa, Artificial Sequence; identical to SEQ ID NO: 16738
  neuraminidase__InfluenzaA__AFJ76173

SEQ ID NO: 22254 - protein, 469 aa, Artificial Sequence; identical to SEQ ID NO: 16738
  neuraminidase__InfluenzaA__AFJ76191

SEQ ID NO: 22255 - protein, 470 aa, Artificial Sequence
  neuraminidase__InfluenzaA__AFJ76192
MNPNQKIITIGSISIAIGIISLMVQIGNIISIWASHSIQTGIQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 22256 - protein, 469 aa, Artificial Sequence; identical to SEQ ID NO: 16738
  neuraminidase__InfluenzaA__AFJ76206

SEQ ID NO: 22257 - protein, 469 aa, Artificial Sequence
  neuraminidase__InfluenzaA__AFJ76216
MNPNQKIITIGSVSLTIATICFLMQIAILVTTVTLHFKQHECNSPPNNQVMLCEPTIIKRNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 22258 - protein, 469 aa, Artificial Sequence
  neuraminidase__InfluenzaA__AFJ77411
MNPNQKIITIGSVSLTIATICFLMQIVILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCLNPNNEEGGHGVKGWAFDDGNDVWMGRTISEKLRSGYETFKVIGGWSKPNSKLQINRQVIVDRGNRSGYSGIFSVEGKSCVNRCFYVELIRGRKQETEVWWTSNSIVVFCGTSGTYGTGSWPDGADINLMPI

SEQ ID NO: 22259 - protein, 469 aa, Artificial Sequence
  neuraminidase__InfluenzaA__AFJ77422
MNPNQKIITIGSVSLTIATICFLMQIAILVITVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYSGVRCVCRDNWKGSNRPIVDINVKDYSIVSSFVCSGLVGDTPRKNDSSSSSHCLNPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22260 - protein, 469 aa, Artificial Sequence
  neuraminidase__InfluenzaA__AFJ77433
MNPNQKIITIGSVSLTIATICFLMQIVILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKTDSSSSSDCLNPNNEEGGHGVKGWAFDDGNDVWMGRTISEKLRSGYETFKVIGGWSKPNSKLQINRQVIVDRGNRSGYSGIFSVEGKSCVNRCFYVELIRGRKQETEVWWTSNSIVVFCGTSGTYGTGSWPDGADINLMPI

SEQ ID NO: 22261 - protein, 469 aa, Artificial Sequence
  neuraminidase__InfluenzaA__AFJ77443
MNPNQKIITIGSVSLTIATICFLMQIAILVITLTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDFSIVSSYVCSGLVGDTPRKNDSSSSSHCLNPNNEEGGNGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22262 - protein, 469 aa, Artificial Sequence
  neuraminidase__InfluenzaA__AFJ77465
MNPNQKIITIGSVSLTIATICFLMQIAILVTTVTLHFKQYECNPPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLSGSAQHVEECSCYPRYPGVRCVCRDNWKGSNRPIVDINVKNYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22263 - protein, 469 aa, Artificial Sequence
  neuraminidase__InfluenzaA__AFJ77476
MNPNQKIITIGSVSLTIATICFLMQIAILVTTVTLHFKQYECNSLPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYGGRLVDSIGSWSKKILRTQESECVCINGTCTVVMTDGSASGRADTKILFIEEGKIIHISQLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKFRSGYETFKVIEGWSKPNSKLQINRQIIVDRDNRSGYSGIFSVEGKSCINRCFYVELIRGRKQETEVWWTSNSIVVFCGTSGTYGTGSWPDGADINLMPI

SEQ ID NO: 22264 - protein, 469 aa, Artificial Sequence; identical to SEQ ID NO: 14315
  neuraminidase__InfluenzaA__AFJ77487

SEQ ID NO: 22265 - protein, 469 aa, Artificial Sequence
  neuraminidase__InfluenzaA__AFJ77498
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHTSKLSGSAQHVEECSCYPRYPGVRCVCRDNWKGSNRPIVDINVKDYSIISSYVCSGLVGDTPRKNDSSSSSHCLDPNNEEGGHGVKGWAFDDGNDVWMGRTISEKSRSGYETFKVIEGWSKPNSKLQINRQVIVERGNMSGYSGIFSVEGKSCINRCFYVELIRGRKQETEVWWTSNSIVVFCGTSGTYGTGSWPDGADINLMPI

SEQ ID NO: 22266 - protein, 469 aa, Artificial Sequence; identical to SEQ ID NO: 14315
  neuraminidase__InfluenzaA__AFJ77509

SEQ ID NO: 22267 - protein, 469 aa, Artificial Sequence
  neuraminidase__InfluenzaA__AFJ77520
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQEIEVLWTSNSIVVFCGTSGTYGTGSWPDGADINLMPI

SEQ ID NO: 22268 - protein, 469 aa, Artificial Sequence
  neuraminidase__InfluenzaA__AFJ77531
MNPNQKIITIGSVSLTITTICFLMQIAILVITVTLHFKQCECNSPPNNQVMLCEPTIIERNITEIVYLTNTTIEKEICPKLAEYRNWSKPQCKVTGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHNENATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPIVDINVKDYSIVSSYVCSGLVGDTPRKNDSSSSSYCLDPNNEEGGHGVKGWAFDDGNDVWMGRTISEKLRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22269 - protein, 469 aa, Artificial Sequence
  neuraminidase__InfluenzaA__AFJ77542
MNPNQKIITIGSVSLTISTICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 22270 - protein, 469 aa, Artificial Sequence; identical to SEQ ID NO: 14253
  neuraminidase__InfluenzaA__AFJ77553

SEQ ID NO: 22271 - protein, 469 aa, Artificial Sequence
  neuraminidase__InfluenzaA__AFJ77564
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISQLSGSAQHVEECSCYPRYPGVRCVCRDNWKGSNRPIVDINVKDYSIVSSYVCSGLVGDTPRKNDSSSSSHCLNPNNEEGGHGVKGWAFDDGNDVWMGRTISEKLRSGYETFKVIEGWSKPNSKLQINRQVIVDRGNRSGYSGIFSVEGKSCINRCFYVELIRGRKQENEVWWTSNSIVVFCGTSGTYGTGSWPDGADINLMPI

SEQ ID NO: 22272 - protein, 442 aa, Artificial Sequence
  neuraminidase__InfluenzaA__AFJ77575
MNPNQKIITIGSVSLTIATICFLMQIAILVIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 22273 - protein, 469 aa, Artificial Sequence
  neuraminidase__InfluenzaA__AFJ77597
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTRPLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 22274 - protein, 469 aa, Artificial Sequence
  neuraminidase__InfluenzaA__AFJ77608
MNPNQKIITIGSVSLTIATICFLMQTAILVTTVTLHFKQYECNSPPNNQVMLCEPTIIERNMTEIVYLTNTTIEKEICPKLAEYRNWSKPQCNITGFAPFSKDNSIRLSAGGDLWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 22275 - protein, 469 aa, Artificial Sequence; identical to SEQ ID NO: 22273
  neuraminidase__InfluenzaA__AFJ77619

SEQ ID NO: 22276 - protein, 469 aa, Artificial Sequence; identical to SEQ ID NO: 22273
  neuraminidase__InfluenzaA__AFJ77630

SEQ ID NO: 22277 - protein, 469 aa, Artificial Sequence; identical to SEQ ID NO: 22269
  neuraminidase__InfluenzaA__AFJ77641

SEQ ID NO: 22278 - protein, 469 aa, Artificial Sequence; identical to SEQ ID NO: 22269
  neuraminidase__InfluenzaA__AFJ77652

SEQ ID NO: 22279 - protein, 469 aa, Artificial Sequence; identical to SEQ ID NO: 14040
  neuraminidase__InfluenzaA__AFJ77663

SEQ ID NO: 22280 - protein, 469 aa, Artificial Sequence; identical to SEQ ID NO: 14040
  neuraminidase__InfluenzaA__AFJ77674

SEQ ID NO: 22281 - protein, 469 aa, Artificial Sequence; identical to SEQ ID NO: 14040
  neuraminidase__InfluenzaA__AFJ77685

SEQ ID NO: 22282 - protein, 469 aa, Artificial Sequence
  neuraminidase__InfluenzaA__AFJ77696
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASEKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 22283 - protein, 469 aa, Artificial Sequence; identical to SEQ ID NO: 14040
  neuraminidase__InfluenzaA__AFJ77707

SEQ ID NO: 22284 - protein, 469 aa, Artificial Sequence; identical to SEQ ID NO: 14061
  neuraminidase__InfluenzaA__AFJ77718

SEQ ID NO: 22285 - protein, 469 aa, Artificial Sequence; identical to SEQ ID NO: 14061
  neuraminidase__InfluenzaA__AFJ77729

SEQ ID NO: 22286 - protein, 469 aa, Artificial Sequence
  neuraminidase__InfluenzaA__AFJ77740
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCIVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 22287 - protein, 469 aa, Artificial Sequence
  neuraminidase__InfluenzaA__AFJ77751
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVRDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIFSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 22288 - protein, 469 aa, Artificial Sequence; identical to SEQ ID NO: 14145
  neuraminidase__InfluenzaA__AFJ77762

SEQ ID NO: 22289 - protein, 469 aa, Artificial Sequence; identical to SEQ ID NO: 14145
  neuraminidase__InfluenzaA__AFJ77773

SEQ ID NO: 22290 - protein, 469 aa, Artificial Sequence; identical to SEQ ID NO: 14145
  neuraminidase__InfluenzaA__AFJ77784

SEQ ID NO: 22291 - protein, 469 aa, Artificial Sequence; identical to SEQ ID NO: 14714
  neuraminidase__InfluenzaA__AFJ77795

SEQ ID NO: 22292 - protein, 469 aa, Artificial Sequence; identical to SEQ ID NO: 14714
  neuraminidase__InfluenzaA__AFJ77806

SEQ ID NO: 22293 - protein, 469 aa, Artificial Sequence; identical to SEQ ID NO: 14714
  neuraminidase__InfluenzaA__AFJ77817

SEQ ID NO: 22294 - protein, 469 aa, Artificial Sequence; identical to SEQ ID NO: 14714
  neuraminidase__InfluenzaA__AFJ77828

SEQ ID NO: 22295 - protein, 469 aa, Artificial Sequence
  neuraminidase__InfluenzaA__AFJ77839
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIIHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 22296 - protein, 469 aa, Artificial Sequence
  neuraminidase__InfluenzaA__AFJ77850
MNPNQKIITIGSVSLTISTICFFMQIAILITTVTLHFKQYEFNSPPNNQVMLCEPTIIERNITEIVYLTNTTIEKEICPKLAKYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 22297 - protein, 469 aa, Artificial Sequence; identical to SEQ ID NO: 14714
  neuraminidase__InfluenzaA__AFJ77861

SEQ ID NO: 22298 - protein, 469 aa, Artificial Sequence; identical to SEQ ID NO: 14714
  neuraminidase__InfluenzaA__AFJ77872

SEQ ID NO: 22299 - protein, 469 aa, Artificial Sequence; identical to SEQ ID NO: 15180
  neuraminidase__InfluenzaA__AFJ77883

SEQ ID NO: 22300 - protein, 469 aa, Artificial Sequence; identical to SEQ ID NO: 14714
  neuraminidase__InfluenzaA__AFJ77894

SEQ ID NO: 22301 - protein, 469 aa, Artificial Sequence; identical to SEQ ID NO: 14714
  neuraminidase__InfluenzaA__AFJ77905

SEQ ID NO: 22302 - protein, 469 aa, Artificial Sequence
  neuraminidase__InfluenzaA__AFJ77916
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIIVFCGTSGTYGTGSWPDGADINLMPI

SEQ ID NO: 22303 - protein, 469 aa, Artificial Sequence; identical to SEQ ID NO: 14736
  neuraminidase__InfluenzaA__AFJ77927

SEQ ID NO: 22304 - protein, 469 aa, Artificial Sequence; identical to SEQ ID NO: 14736
  neuraminidase__InfluenzaA__AFJ77938

SEQ ID NO: 22305 - protein, 469 aa, Artificial Sequence; identical to SEQ ID NO: 14714
  neuraminidase__InfluenzaA__AFJ77949

SEQ ID NO: 22306 - protein, 469 aa, Artificial Sequence; identical to SEQ ID NO: 14714
  neuraminidase__InfluenzaA__AFJ77960

SEQ ID NO: 22307 - protein, 469 aa, Artificial Sequence
  neuraminidase__InfluenzaA__AFJ77971
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKDETEVLWTSNSIVVFCGTSGTYGTGSWPDGADINLMPI

SEQ ID NO: 22308 - protein, 469 aa, Artificial Sequence
  neuraminidase__InfluenzaA__AFJ77982
MNPNQKIITIGFVSLTISTICFFMQIAILITTVPLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGIVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 22309 - protein, 469 aa, Artificial Sequence; identical to SEQ ID NO: 14712
  neuraminidase__InfluenzaA__AFJ77993

SEQ ID NO: 22310 - protein, 469 aa, Artificial Sequence
  neuraminidase__InfluenzaA__AFJ78004
MNPNQKIITIGSVSLTISTICFFMQIAILITTVTLHFKQYEFNSPPNNQVMLCEPTIIEKNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 22311 - protein, 469 aa, Artificial Sequence; identical to SEQ ID NO: 14712
  neuraminidase__InfluenzaA__AFJ78015

SEQ ID NO: 22312 - protein, 469 aa, Artificial Sequence; identical to SEQ ID NO: 21569
  neuraminidase__InfluenzaA__AFJ78026

SEQ ID NO: 22313 - protein, 469 aa, Artificial Sequence; identical to SEQ ID NO: 21569
  neuraminidase__InfluenzaA__AFJ78037

SEQ ID NO: 22314 - protein, 469 aa, Artificial Sequence
  neuraminidase__InfluenzaA__AFJ78048
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGNASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 22315 - protein, 469 aa, Artificial Sequence
  neuraminidase__InfluenzaA__AFJ78059
MNPNQKIITIGSVSLTISTICFFMQIAILITTVTLHFKQYEFNPPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKDETEVLWTSNSIVVFCGTSGTYGTGSWPDGADINLMPI

SEQ ID NO: 22316 - protein, 469 aa, Artificial Sequence
  neuraminidase__InfluenzaA__AFJ78070
MNPNQKIITIGSVSLTISTICFFMQIAILITTVTLHFKQYEFNSPPNNQVMLCEPTIIERNITEIVYLTNTTIEKEICPKLAEYRKWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSGHCLDPNNEEGGHGVKGWAFDDGNDVWMGRTISEKSRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 22317 - protein, 469 aa, Artificial Sequence
  neuraminidase__InfluenzaA__AFJ78081
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDNSSSSHCLDPNNEEGGHGVKGWAFDDGNDVWMGRTISEKSRLGYETFKVIEGWSNPNSKLQMNRQVIVDRGNRSGYSGIFSVEGKSCINRCFYVELIRGRKEETEVLWTSNSIVVFCGTSGTYGTGSWPDGADINLMPI

SEQ ID NO: 22318 - protein, 469 aa, Artificial Sequence; identical to SEQ ID NO: 22234
  neuraminidase__InfluenzaA__AFJ78092

SEQ ID NO: 22319 - protein, 469 aa, Artificial Sequence
  neuraminidase__InfluenzaA__AFJ78103
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLLGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTISEKSRLGYETFKVIEGWSNPSSKLQINRQVIVDRGNRSGYSGIFSVEGKSCINRCFYVELIRGRKEETEVLWTSNSIVVFCGTSGTYGTGSWPDGADINLMPI

SEQ ID NO: 22320 - protein, 469 aa, Artificial Sequence
  neuraminidase__InfluenzaA__AFJ78114
MNPNQKIITIGSVSLTISTICFFMQIAILITTVTLHFKQYELNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPNSKLQINRQVIVDRSNRSGYSGIFSVEGKSCINRCFYVELIRGRKEETEVLWTSNSIVVFCGTSGTYGTGSWPDGADINLMPI

SEQ ID NO: 22321 - protein, 469 aa, Artificial Sequence
  neuraminidase__InfluenzaA__AFJ78125
MNPNQKIITIGSVSLTISTICFFMQIAILITTVTLHFKQYEFNSPPNNQVMLCEPTIIERNITEIVYLTNTTIEKEMCPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPNSKLQMNRQVIVDRGNRSGYSGIFSVEGKSCINRCFYVELIRGRKEETEVLWTSNSIVVFCGTSGTYGTGSWPDGADINLMPI

SEQ ID NO: 22322 - protein, 469 aa, Artificial Sequence
  neuraminidase__InfluenzaA__AFJ78136
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22323 - protein, 469 aa, Artificial Sequence; identical to SEQ ID NO: 22322
  neuraminidase__InfluenzaA__AFJ78147

SEQ ID NO: 22324 - protein, 469 aa, Artificial Sequence; identical to SEQ ID NO: 22322
  neuraminidase__InfluenzaA__AFJ78158

SEQ ID NO: 22325 - protein, 469 aa, Artificial Sequence; identical to SEQ ID NO: 15884
  neuraminidase__InfluenzaA__AFJ78169

SEQ ID NO: 22326 - protein, 469 aa, Artificial Sequence; identical to SEQ ID NO: 16402
  neuraminidase__InfluenzaA__AFJ78180

SEQ ID NO: 22327 - protein, 469 aa, Artificial Sequence; identical to SEQ ID NO: 15884
  neuraminidase__InfluenzaA__AFJ78191

SEQ ID NO: 22328 - protein, 469 aa, Artificial Sequence
  neuraminidase__InfluenzaA__AFJ78202
MNPNQKIITIGSVSLTISTICFFMQTAILITTVTLHFKQYEFNSPPNNQVMLCEPTIIERNITEIVYLINTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGGAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADISLMPI

SEQ ID NO: 22329 - protein, 469 aa, Artificial Sequence
  neuraminidase__InfluenzaA__AFJ78213
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMLI

SEQ ID NO: 22330 - protein, 469 aa, Artificial Sequence; identical to SEQ ID NO: 15884
  neuraminidase__InfluenzaA__AFJ78224

SEQ ID NO: 22331 - protein, 469 aa, Artificial Sequence; identical to SEQ ID NO: 15884
  neuraminidase__InfluenzaA__AFJ78235

SEQ ID NO: 22332 - protein, 469 aa, Artificial Sequence
  neuraminidase__InfluenzaA__AFJ78246
MNPNQKIITIGSVSLTISTICFFMQIAILITTVTLHFKQYEFNSPPNNQAMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22333 - protein, 469 aa, Artificial Sequence
  neuraminidase__InfluenzaA__AFJ78268
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSKLSGSAQHVEECSCYPRYPGVRCVCRDNWKGSNRPIVDINMKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22334 - protein, 469 aa, Artificial Sequence
  neuraminidase__InfluenzaA__AFJ78279
MNPNQKIITIGSVSLTISTICFFMQTAILITTVTLHFKQYEFNSPPNNQVMLCEPTIIERNITEIVYLINTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGGAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22335 - protein, 469 aa, Artificial Sequence
  neuraminidase__InfluenzaA__AFJ78290
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSALSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22336 - protein, 470 aa, Artificial Sequence
  neuraminidase__InfluenzaA__AFJ78312
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWEKRILRTQESECVCVNGSCFTIMTDGPSNGAASYKIFKIEKGKVTKSIELNAPNSHYEECSCYPDTGTVMCVCRDNWHGSNRPWVSFNQNLDYQIGYICSGVFGDNPRPKDGEGSCNPVTADGADGVKGFSYKYGNGVWIGRTKSNRLRKGFEMIWDPNGWTDTDSDFSVKQDVVAITDWSGYSGSFVQHPELTGLDCIRPCFWVELVRGRPRENTTIWTSGSSISFCGVNSDTANWSWPDGAELPFTIDK

SEQ ID NO: 22337 - protein, 469 aa, Artificial Sequence; identical to SEQ ID NO: 22269
  neuraminidase__InfluenzaA__AFJ78323

SEQ ID NO: 22338 - protein, 470 aa, Artificial Sequence
  neuraminidase__InfluenzaA__AFJ78334
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 22339 - protein, 470 aa, Artificial Sequence; identical to SEQ ID NO: 22338
  neuraminidase__InfluenzaA__AFJ78345

SEQ ID NO: 22340 - protein, 470 aa, Artificial Sequence
  neuraminidase__InfluenzaA__AFJ78356
MNPNQKIITIGSISIAIGIISLMLQIGNIISIWASHSIQTGSQNHTGICNQRIITYENSTWVNHTYVNINNTNVVVGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCICRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 22341 - protein, 470 aa, Artificial Sequence
  neuraminidase__InfluenzaA__AFJ78367
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNSHYEECSCYPDTGTVMCVCRDNWHGSNRPWVSFNQNLDYQIGYICSGVFGDNPRPKDGEGSCNPVTADGADGVKGFSYKYGNGVWIGRTKSNRLRKGFEMIWDPNGWTDTDSDFSVKQDVVAITDWSGYSGSFVQHPELTGLDCIRPCFWVELVRGRPRENTTIWTSGSSISFCGVNGDTANWSWPDGAELPFTIDK

SEQ ID NO: 22342 - protein, 470 aa, Artificial Sequence
  neuraminidase__InfluenzaA__AFJ78378
MNPNQKVITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHMECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNSHYEECSCYPDTGTVMCVCRDNWHGSNRPWVSFNQNLDYQIGYICSGVFGDNPRPRDGEGSCNPVTVDGADGVKGFSYKYGNGVWIGRTKSNRLRKGFEMIWDPNGWTDTDSDFAVKQDVVAITDWSGYSGSFVQHPELTGLDCIRPCFWVELVRGLPRENTTIWTSGSSISFCGVNSDTANWSWPDGAELPFTIDK

SEQ ID NO: 22343 - protein, 470 aa, Artificial Sequence; identical to SEQ ID NO: 14386
  neuraminidase__InfluenzaA__AFJ78389

SEQ ID NO: 22344 - protein, 470 aa, Artificial Sequence; identical to SEQ ID NO: 14386
  neuraminidase__InfluenzaA__AFJ78400

SEQ ID NO: 22345 - protein, 470 aa, Artificial Sequence; identical to SEQ ID NO: 14386
  neuraminidase__InfluenzaA__AFJ78411

SEQ ID NO: 22346 - protein, 470 aa, Artificial Sequence
  neuraminidase__InfluenzaA__AFJ78422
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGTGWLTIGISGPDNGAVAVLKYNGIITETIKSWKKRILRTQESECVCMNGSCFTIMTDGPSNGAASYKIFKIEKGKVTKSIELNAPSFHYEECSCYPDTGTVMCVCRDNWHGSNRPWVSFNQNLDYQIGYICSGVFGDNPRPQDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 22347 - protein, 470 aa, Artificial Sequence; identical to SEQ ID NO: 16493
  neuraminidase__InfluenzaA__AFJ78433

SEQ ID NO: 22348 - protein, 470 aa, Artificial Sequence; identical to SEQ ID NO: 16493
  neuraminidase__InfluenzaA__AFJ78444

SEQ ID NO: 22349 - protein, 470 aa, Artificial Sequence
  neuraminidase__InfluenzaA__AFJ78466
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGIGWLTIGISGPDNGAVAVLKYNGIITGTIKSWKKQILRTQESECVCINGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGRCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 22350 - protein, 470 aa, Artificial Sequence
  neuraminidase__InfluenzaA__AFJ78477
MNPNQKIITIGSISIAIGIIGLMLQIGNIISIWASHSIQTGSQNHTGICSQRIITYENSTWVNNTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSGTANWSWPDGAELPFTIDK

SEQ ID NO: 22351 - protein, 470 aa, Artificial Sequence
  neuraminidase__InfluenzaA__AFJ78488
MNPNQKIITIGSISIAIGIISLILQIGNIISIWASHSIQTGSQNHTGICNQRIITYENSTWVNNTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGAASYKIFKIEKGKVTKTIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSMKQDVVAITDWSGYSGSFVQHPELTGLDCIRPCFWVELVRGLPRENTTIWTSGSSISFCGVNSGTANWSWPDGAELPFTIDK

SEQ ID NO: 22352 - protein, 470 aa, Artificial Sequence
  neuraminidase__InfluenzaA__AFJ78510
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNGAASYKIFKIEKGKVTKSIELNAPNFHYEECSCYPDTGIVMCVCRDNWHGSNRPWVSFNQNLDYQIGYICSGVFGDNPRPKDGEGSCNPVTVDGADGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 22353 - protein, 470 aa, Artificial Sequence
  neuraminidase__InfluenzaA__AFJ78521
MNPNQKIITIGSISIAIGIISLILQIGNIISIWASHSIQTGSQNHTGICNQRIITYENSTWVNNTYVNINNTNVVAEKDKTSVTLAGNSSLCSISGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCMNGSCFTIMTDGPSNGAASYKIFKIEKGKVTKTIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSGTANWSWPDGAELPFTIDK

SEQ ID NO: 22354 - protein, 470 aa, Artificial Sequence; identical to SEQ ID NO: 22247
  neuraminidase__InfluenzaA__AFJ78532

SEQ ID NO: 22355 - protein, 470 aa, Artificial Sequence; identical to SEQ ID NO: 22247
  neuraminidase__InfluenzaA__AFJ78543

SEQ ID NO: 22356 - protein, 470 aa, Artificial Sequence; identical to SEQ ID NO: 22247
  neuraminidase__InfluenzaA__AFJ78554

SEQ ID NO: 22357 - protein, 470 aa, Artificial Sequence; identical to SEQ ID NO: 22235
  neuraminidase__InfluenzaA__AFJ78565

SEQ ID NO: 22358 - protein, 470 aa, Artificial Sequence
  neuraminidase__InfluenzaA__AFJ78576
MNPNQKIITIGSISIAIGIISLMLQIGNIISIWASHSIQTGSQNHTGICNQRIITYENSTWVNHTYVNINNTNVVAGKDKTPVTLAGNSSLCSISGWAIHTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYNGIITGTIKSWKKQILRTQESECVCMNGSCFTIMTDGPSNGAASYKIFKIEKGKVTKSMELNAPNFHYEECSCYPDTGTVMCVCRDNWHGSNRPWVSFNQNLDYQIGYICTGVFGDNPRPEDGEGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNSDIANWSWPDGAELPFTIDK

SEQ ID NO: 22359 - protein, 470 aa, Artificial Sequence
  neuraminidase__InfluenzaA__AFJ78598
MNPNQKIITIGSISIAIGIISLMLQIGNIISIWASHSIQTGIQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 22360 - protein, 470 aa, Artificial Sequence
  neuraminidase__InfluenzaA__AFJ78609
MNPNQKIITIGSISIAIGIISLMLQIGNIISIWASHSIQTGSQNNTGICNQRIITYENSTWVNHTYVNINNTNVVAGEDKTSVILAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFYYEECSCYPDTGIVMCVCRDNWHGSNRPWVSFNQNLDYQIGYICSGVFGDNPRPEDGEGSCNPVTVDGANGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 22361 - protein, 470 aa, Artificial Sequence; identical to SEQ ID NO: 17461
  neuraminidase__InfluenzaA__AFJ78620

SEQ ID NO: 22362 - protein, 470 aa, Artificial Sequence; identical to SEQ ID NO: 22235
  neuraminidase__InfluenzaA__AFJ78631

SEQ ID NO: 22363 - protein, 470 aa, Artificial Sequence; identical to SEQ ID NO: 17461
  neuraminidase__InfluenzaA__AFJ78642

SEQ ID NO: 22364 - protein, 470 aa, Artificial Sequence; identical to SEQ ID NO: 17461
  neuraminidase__InfluenzaA__AFJ78653

SEQ ID NO: 22365 - protein, 469 aa, Artificial Sequence; identical to SEQ ID NO: 16738
  neuraminidase__InfluenzaA__AFJ78664

SEQ ID NO: 22366 - protein, 469 aa, Artificial Sequence; identical to SEQ ID NO: 16738
  neuraminidase__InfluenzaA__AFJ78674

SEQ ID NO: 22367 - protein, 469 aa, Artificial Sequence; identical to SEQ ID NO: 16738
  neuraminidase__InfluenzaA__AFJ78684

SEQ ID NO: 22368 - protein, 469 aa, Artificial Sequence; identical to SEQ ID NO: 16738
  neuraminidase__InfluenzaA__AFJ78694

SEQ ID NO: 22369 - protein, 469 aa, Artificial Sequence; identical to SEQ ID NO: 16738
  neuraminidase__InfluenzaA__AFJ78704

SEQ ID NO: 22370 - protein, 469 aa, Artificial Sequence; identical to SEQ ID NO: 16738
  neuraminidase__InfluenzaA__AFJ78714

SEQ ID NO: 22371 - protein, 469 aa, Artificial Sequence
  neuraminidase__InfluenzaA__AFJ78724
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTLMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22372 - protein, 469 aa, Artificial Sequence; identical to SEQ ID NO: 16738
  neuraminidase__InfluenzaA__AFJ78734

SEQ ID NO: 22373 - protein, 469 aa, Artificial Sequence; identical to SEQ ID NO: 16738
  neuraminidase__InfluenzaA__AFJ78744

SEQ ID NO: 22374 - protein, 469 aa, Artificial Sequence; identical to SEQ ID NO: 16738
  neuraminidase__InfluenzaA__AFJ78754

SEQ ID NO: 22375 - protein, 469 aa, Artificial Sequence; identical to SEQ ID NO: 16738
  neuraminidase__InfluenzaA__AFJ78764

SEQ ID NO: 22376 - protein, 469 aa, Artificial Sequence; identical to SEQ ID NO: 16738
  neuraminidase__InfluenzaA__AFJ78774

SEQ ID NO: 22377 - protein, 469 aa, Artificial Sequence; identical to SEQ ID NO: 16738
  neuraminidase__InfluenzaA__AFJ78784

SEQ ID NO: 22378 - protein, 469 aa, Artificial Sequence
  neuraminidase__InfluenzaA__AFJ78794
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSGEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22379 - protein, 469 aa, Artificial Sequence; identical to SEQ ID NO: 16738
  neuraminidase__InfluenzaA__AFJ78804

SEQ ID NO: 22380 - protein, 469 aa, Artificial Sequence; identical to SEQ ID NO: 16738
  neuraminidase__InfluenzaA__AFJ78814

SEQ ID NO: 22381 - protein, 469 aa, Artificial Sequence; identical to SEQ ID NO: 16738
  neuraminidase__InfluenzaA__AFJ78824

SEQ ID NO: 22382 - protein, 469 aa, Artificial Sequence; identical to SEQ ID NO: 16738
  neuraminidase__InfluenzaA__AFJ78834

SEQ ID NO: 22383 - protein, 469 aa, Artificial Sequence; identical to SEQ ID NO: 16738
  neuraminidase__InfluenzaA__AFJ78844

SEQ ID NO: 22384 - protein, 469 aa, Artificial Sequence; identical to SEQ ID NO: 18987
  neuraminidase__InfluenzaA__AFJ78854

SEQ ID NO: 22385 - protein, 469 aa, Artificial Sequence; identical to SEQ ID NO: 16738
  neuraminidase__InfluenzaA__AFJ78864

SEQ ID NO: 22386 - protein, 469 aa, Artificial Sequence; identical to SEQ ID NO: 16738
  neuraminidase__InfluenzaA__AFJ78874

SEQ ID NO: 22387 - protein, 469 aa, Artificial Sequence; identical to SEQ ID NO: 16738
  neuraminidase__InfluenzaA__AFJ78884

SEQ ID NO: 22388 - protein, 469 aa, Artificial Sequence; identical to SEQ ID NO: 16738
  neuraminidase__InfluenzaA__AFJ78894

SEQ ID NO: 22389 - protein, 469 aa, Artificial Sequence; identical to SEQ ID NO: 16738
  neuraminidase__InfluenzaA__AFJ78904

SEQ ID NO: 22390 - protein, 469 aa, Artificial Sequence; identical to SEQ ID NO: 16738
  neuraminidase__InfluenzaA__AFJ78914

SEQ ID NO: 22391 - protein, 469 aa, Artificial Sequence
  neuraminidase__InfluenzaA__AFJ78924
MNPNQKIITIGSVCMTIGMANLILQIGNIISIWISHSIQLGNQNQIETCNQSVITYENNTWVNQTYVDISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEIPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22392 - protein, 469 aa, Artificial Sequence
  neuraminidase__InfluenzaA__AFJ97569
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNETIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVSWSWPDGAELPFTIDK

SEQ ID NO: 22393 - protein, 469 aa, Artificial Sequence; identical to SEQ ID NO: 16728
  neuraminidase__InfluenzaA__AFK14107

SEQ ID NO: 22394 - protein, 469 aa, Artificial Sequence; identical to SEQ ID NO: 16738
  neuraminidase__InfluenzaA__AFK14117

SEQ ID NO: 22395 - protein, 469 aa, Artificial Sequence; identical to SEQ ID NO: 17505
  neuraminidase__InfluenzaA__AFK14141

SEQ ID NO: 22396 - protein, 469 aa, Artificial Sequence
  neuraminidase__InfluenzaA__AFK14150
MNPNQKIITIGSVCMTIGMANLILQIGNIISIWISHSIRLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDEQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22397 - protein, 469 aa, Artificial Sequence; identical to SEQ ID NO: 17321
  neuraminidase__InfluenzaA__AFK14159

SEQ ID NO: 22398 - protein, 469 aa, Artificial Sequence; identical to SEQ ID NO: 16738
  neuraminidase__InfluenzaA__AFK14168

SEQ ID NO: 22399 - protein, 469 aa, Artificial Sequence; identical to SEQ ID NO: 16738
  neuraminidase__InfluenzaA__AFK14177

SEQ ID NO: 22400 - protein, 469 aa, Artificial Sequence
  neuraminidase__InfluenzaA__AFK14186
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHFEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22401 - protein, 469 aa, Artificial Sequence; identical to SEQ ID NO: 18719
  neuraminidase__InfluenzaA__AFK14195

SEQ ID NO: 22402 - protein, 469 aa, Artificial Sequence; identical to SEQ ID NO: 16738
  neuraminidase__InfluenzaA__AFK14204

SEQ ID NO: 22403 - protein, 469 aa, Artificial Sequence; identical to SEQ ID NO: 18719
  neuraminidase__InfluenzaA__AFK14213

SEQ ID NO: 22404 - protein, 469 aa, Artificial Sequence
  neuraminidase__InfluenzaA__AFK14222
MNPNQKIITIGSVCMTIGMANLILQIGNIISIWISHSIRLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22405 - protein, 469 aa, Artificial Sequence; identical to SEQ ID NO: 17321
  neuraminidase__InfluenzaA__AFK14231

SEQ ID NO: 22406 - protein, 469 aa, Artificial Sequence; identical to SEQ ID NO: 16738
  neuraminidase__InfluenzaA__AFK14240

SEQ ID NO: 22407 - protein, 469 aa, Artificial Sequence; identical to SEQ ID NO: 17505
  neuraminidase__InfluenzaA__AFK14249

SEQ ID NO: 22408 - protein, 469 aa, Artificial Sequence; identical to SEQ ID NO: 16738
  neuraminidase__InfluenzaA__AFK14257

SEQ ID NO: 22409 - protein, 469 aa, Artificial Sequence; identical to SEQ ID NO: 16738
  neuraminidase__InfluenzaA__AFK14266

SEQ ID NO: 22410 - protein, 469 aa, Artificial Sequence; identical to SEQ ID NO: 16738
  neuraminidase__InfluenzaA__AFK14274

SEQ ID NO: 22411 - protein, 469 aa, Artificial Sequence
  neuraminidase__InfluenzaA__AFK14281
MNPNQKIITIGSVCMTIGMANLILQIGNIISIWISHSIQLGNQNQIETCNQSVITYENNTWVNQTDVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22412 - protein, 469 aa, Artificial Sequence; identical to SEQ ID NO: 16738
  neuraminidase__InfluenzaA__AFK14289

SEQ ID NO: 22413 - protein, 469 aa, Artificial Sequence; identical to SEQ ID NO: 17321
  neuraminidase__InfluenzaA__AFK14298

SEQ ID NO: 22414 - protein, 469 aa, Artificial Sequence; identical to SEQ ID NO: 16738
  neuraminidase__InfluenzaA__AFK14307

SEQ ID NO: 22415 - protein, 469 aa, Artificial Sequence; identical to SEQ ID NO: 18719
  neuraminidase__InfluenzaA__AFK14316

SEQ ID NO: 22416 - protein, 469 aa, Artificial Sequence
  neuraminidase__InfluenzaA__AFK14325
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIERGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22417 - protein, 469 aa, Artificial Sequence; identical to SEQ ID NO: 16738
  neuraminidase__InfluenzaA__AFK14334

SEQ ID NO: 22418 - protein, 469 aa, Artificial Sequence; identical to SEQ ID NO: 16738
  neuraminidase__InfluenzaA__AFK14343

SEQ ID NO: 22419 - protein, 469 aa, Artificial Sequence; identical to SEQ ID NO: 16738
  neuraminidase__InfluenzaA__AFK14352

SEQ ID NO: 22420 - protein, 469 aa, Artificial Sequence; identical to SEQ ID NO: 16738
  neuraminidase__InfluenzaA__AFK14360

SEQ ID NO: 22421 - protein, 469 aa, Artificial Sequence; identical to SEQ ID NO: 16738
  neuraminidase__InfluenzaA__AFK14369

SEQ ID NO: 22422 - protein, 469 aa, Artificial Sequence
  neuraminidase__InfluenzaA__AFK14387
MNPNQKIITIGSVCMTIGMANLILQIGNITSIWISHSIQLGNQNQIDTCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22423 - protein, 469 aa, Artificial Sequence; identical to SEQ ID NO: 17321
  neuraminidase__InfluenzaA__AFK14397

SEQ ID NO: 22424 - protein, 469 aa, Artificial Sequence; identical to SEQ ID NO: 16738
  neuraminidase__InfluenzaA__AFK14406

SEQ ID NO: 22425 - protein, 469 aa, Artificial Sequence; identical to SEQ ID NO: 16738
  neuraminidase__InfluenzaA__AFK14415

SEQ ID NO: 22426 - protein, 469 aa, Artificial Sequence; identical to SEQ ID NO: 16738
  neuraminidase__InfluenzaA__AFK14424

SEQ ID NO: 22427 - protein, 469 aa, Artificial Sequence
  neuraminidase__InfluenzaA__AFK14433
MNPNQKIITIGSVCMIIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22428 - protein, 469 aa, Artificial Sequence; identical to SEQ ID NO: 16738
  neuraminidase__InfluenzaA__AFK14442

SEQ ID NO: 22429 - protein, 469 aa, Artificial Sequence
  neuraminidase__InfluenzaA__AFK14451
MNPNQKIITIGSVCMTIGMANLILQIGNIISIWISHSIQLGNQNQIETCNQSVITYENNTWVNQTYVNISNTNFAAGQSVASAKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSIISFCGVNSDTVGWSWPDGAELPFTIDK

SEQ ID NO: 22430 - protein, 469 aa, Artificial Sequence; identical to SEQ ID NO: 16738
  neuraminidase__InfluenzaA__AFK14458

SEQ ID NO: 22431 - protein, 469 aa, Artificial Sequence; identical to SEQ ID NO: 16738
  neuraminidase__InfluenzaA__AFK14467

SEQ ID NO: 22432 - protein, 469 aa, Artificial Sequence; identical to SEQ ID NO: 16738
  neuraminidase__InfluenzaA__AFK14476

SEQ ID NO: 22433 - protein, 469 aa, Artificial Sequence; identical to SEQ ID NO: 19797
  neuraminidase__InfluenzaA__AFK14485

SEQ ID NO: 22434 - protein, 469 aa, Artificial Sequence; identical to SEQ ID NO: 16738
  neuraminidase__InfluenzaA__AFK14504

SEQ ID NO: 22435 - protein, 469 aa, Artificial Sequence; identical to SEQ ID NO: 16738
  neuraminidase__InfluenzaA__AFK14514

SEQ ID NO: 22436 - protein, 469 aa, Artificial Sequence; identical to SEQ ID NO: 16738
  neuraminidase__InfluenzaA__AFK14522

SEQ ID NO: 22437 - protein, 469 aa, Artificial Sequence; identical to SEQ ID NO: 16738
  neuraminidase__InfluenzaA__AFK14529

SEQ ID NO: 22438 - protein, 469 aa, Artificial Sequence; identical to SEQ ID NO: 16738
  neuraminidase__InfluenzaA__AFK14538

SEQ ID NO: 22439 - protein, 469 aa, Artificial Sequence; identical to SEQ ID NO: 19113
  neuraminidase__InfluenzaA__AFK14547

SEQ ID NO: 22440 - protein, 469 aa, Artificial Sequence
  neuraminidase__InfluenzaA__AFK14555
MNPNQKIITIGSVCMTIGMANLILQIGNIISIWISHSIQLGNQNQIETCNQSVITYENNTWVNQTYVNISNTNFAAGQSVISVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22441 - protein, 469 aa, Artificial Sequence; identical to SEQ ID NO: 16738
  neuraminidase__InfluenzaA__AFK14564

SEQ ID NO: 22442 - protein, 469 aa, Artificial Sequence; identical to SEQ ID NO: 16738
  neuraminidase__InfluenzaA__AFK14573

SEQ ID NO: 22443 - protein, 469 aa, Artificial Sequence
  neuraminidase__InfluenzaA__AFK14579
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYMCSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22444 - protein, 469 aa, Artificial Sequence; identical to SEQ ID NO: 16738
  neuraminidase__InfluenzaA__AFK14588

SEQ ID NO: 22445 - protein, 469 aa, Artificial Sequence; identical to SEQ ID NO: 16738
  neuraminidase__InfluenzaA__AFK14597

SEQ ID NO: 22446 - protein, 469 aa, Artificial Sequence; identical to SEQ ID NO: 16738
  neuraminidase__InfluenzaA__AFK14604

SEQ ID NO: 22447 - protein, 469 aa, Artificial Sequence; identical to SEQ ID NO: 16738
  neuraminidase__InfluenzaA__AFK14632

SEQ ID NO: 22448 - protein, 469 aa, Artificial Sequence; identical to SEQ ID NO: 16728
  neuraminidase__InfluenzaA__AFK14641

SEQ ID NO: 22449 - protein, 469 aa, Artificial Sequence; identical to SEQ ID NO: 16738
  neuraminidase__InfluenzaA__AFK14651

SEQ ID NO: 22450 - protein, 469 aa, Artificial Sequence; identical to SEQ ID NO: 16738
  neuraminidase__InfluenzaA__AFK14656

SEQ ID NO: 22451 - protein, 469 aa, Artificial Sequence; identical to SEQ ID NO: 16738
  neuraminidase__InfluenzaA__AFK14663

SEQ ID NO: 22452 - protein, 469 aa, Artificial Sequence; identical to SEQ ID NO: 16738
  neuraminidase__InfluenzaA__AFK14672

SEQ ID NO: 22453 - protein, 469 aa, Artificial Sequence; identical to SEQ ID NO: 16738
  neuraminidase__InfluenzaA__AFK14680

SEQ ID NO: 22454 - protein, 469 aa, Artificial Sequence; identical to SEQ ID NO: 16738
  neuraminidase__InfluenzaA__AFK14690

SEQ ID NO: 22455 - protein, 469 aa, Artificial Sequence; identical to SEQ ID NO: 16738
  neuraminidase__InfluenzaA__AFK14707

SEQ ID NO: 22456 - protein, 469 aa, Artificial Sequence; identical to SEQ ID NO: 16738
  neuraminidase__InfluenzaA__AFK14715

SEQ ID NO: 22457 - protein, 469 aa, Artificial Sequence; identical to SEQ ID NO: 16738
  neuraminidase__InfluenzaA__AFK14724

SEQ ID NO: 22458 - protein, 469 aa, Artificial Sequence; identical to SEQ ID NO: 16738
  neuraminidase__InfluenzaA__AFK14733

SEQ ID NO: 22459 - protein, 469 aa, Artificial Sequence; identical to SEQ ID NO: 16738
  neuraminidase__InfluenzaA__AFK14751

SEQ ID NO: 22460 - protein, 469 aa, Artificial Sequence; identical to SEQ ID NO: 16738
  neuraminidase__InfluenzaA__AFK14757

SEQ ID NO: 22461 - protein, 469 aa, Artificial Sequence; identical to SEQ ID NO: 16738
  neuraminidase__InfluenzaA__AFK14766

SEQ ID NO: 22462 - protein, 469 aa, Artificial Sequence; identical to SEQ ID NO: 17321
  neuraminidase__InfluenzaA__AFK14774

SEQ ID NO: 22463 - protein, 469 aa, Artificial Sequence; identical to SEQ ID NO: 22440
  neuraminidase__InfluenzaA__AFK14781

SEQ ID NO: 22464 - protein, 469 aa, Artificial Sequence; identical to SEQ ID NO: 17321
  neuraminidase__InfluenzaA__AFK14790

SEQ ID NO: 22465 - protein, 469 aa, Artificial Sequence
  neuraminidase__InfluenzaA__AFK14800
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPRENTIWTSGSSISFCGVNSDTVGWSWPDGAELPFTIDK

SEQ ID NO: 22466 - protein, 469 aa, Artificial Sequence; identical to SEQ ID NO: 18719
  neuraminidase__InfluenzaA__AFK14809

SEQ ID NO: 22467 - protein, 469 aa, Artificial Sequence; identical to SEQ ID NO: 18719
  neuraminidase__InfluenzaA__AFK14816

SEQ ID NO: 22468 - protein, 469 aa, Artificial Sequence; identical to SEQ ID NO: 16738
  neuraminidase__InfluenzaA__AFK14824

SEQ ID NO: 22469 - protein, 469 aa, Artificial Sequence; identical to SEQ ID NO: 16738
  neuraminidase__InfluenzaA__AFK14841

SEQ ID NO: 22470 - protein, 469 aa, Artificial Sequence; identical to SEQ ID NO: 17811
  neuraminidase__InfluenzaA__AFK14849

SEQ ID NO: 22471 - protein, 469 aa, Artificial Sequence
  neuraminidase__InfluenzaA__AFK14856
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFKIEKGKIVKSVEMNAPNYHYEECSCYPDSSEITCVCRDNWHGSNRPWVSFNQNLEYQIGYICSGIFGDNPRPIDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22472 - protein, 469 aa, Artificial Sequence; identical to SEQ ID NO: 16738
  neuraminidase__InfluenzaA__AFK14870

SEQ ID NO: 22473 - protein, 469 aa, Artificial Sequence; identical to SEQ ID NO: 16738
  neuraminidase__InfluenzaA__AFK14879

SEQ ID NO: 22474 - protein, 469 aa, Artificial Sequence; identical to SEQ ID NO: 16738
  neuraminidase__InfluenzaA__AFK14885

SEQ ID NO: 22475 - protein, 469 aa, Artificial Sequence; identical to SEQ ID NO: 16738
  neuraminidase__InfluenzaA__AFK14894

SEQ ID NO: 22476 - protein, 469 aa, Artificial Sequence; identical to SEQ ID NO: 16738
  neuraminidase__InfluenzaA__AFK14903

SEQ ID NO: 22477 - protein, 469 aa, Artificial Sequence; identical to SEQ ID NO: 16738
  neuraminidase__InfluenzaA__AFK14912

SEQ ID NO: 22478 - protein, 469 aa, Artificial Sequence; identical to SEQ ID NO: 16738
  neuraminidase__InfluenzaA__AFK14921

SEQ ID NO: 22479 - protein, 469 aa, Artificial Sequence; identical to SEQ ID NO: 16738
  neuraminidase__InfluenzaA__AFK14931

SEQ ID NO: 22480 - protein, 469 aa, Artificial Sequence
  neuraminidase__InfluenzaA__AFK25604
MNPNQKIITIGSVCMTIGMANLILQIGNIISIWISHSIQLRNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22481 - protein, 469 aa, Artificial Sequence; identical to SEQ ID NO: 22480
  neuraminidase__InfluenzaA__AFK25606

SEQ ID NO: 22482 - protein, 469 aa, Artificial Sequence; identical to SEQ ID NO: 18089
  neuraminidase__InfluenzaA__AFK74537

SEQ ID NO: 22483 - protein, 469 aa, Artificial Sequence; identical to SEQ ID NO: 16738
  neuraminidase__InfluenzaA__AFK74547

SEQ ID NO: 22484 - protein, 469 aa, Artificial Sequence; identical to SEQ ID NO: 19730
  neuraminidase__InfluenzaA__AFK74557

SEQ ID NO: 22485 - protein, 469 aa, Artificial Sequence; identical to SEQ ID NO: 16738
  neuraminidase__InfluenzaA__AFK74567

SEQ ID NO: 22486 - protein, 469 aa, Artificial Sequence; identical to SEQ ID NO: 16738
  neuraminidase__InfluenzaA__AFK74578

SEQ ID NO: 22487 - protein, 469 aa, Artificial Sequence; identical to SEQ ID NO: 21853
  neuraminidase__InfluenzaA__AFK74588

SEQ ID NO: 22488 - protein, 469 aa, Artificial Sequence; identical to SEQ ID NO: 16738
  neuraminidase__InfluenzaA__AFK74598

SEQ ID NO: 22489 - protein, 469 aa, Artificial Sequence; identical to SEQ ID NO: 16738
  neuraminidase__InfluenzaA__AFK74608

SEQ ID NO: 22490 - protein, 469 aa, Artificial Sequence; identical to SEQ ID NO: 16738
  neuraminidase__InfluenzaA__AFK74618

SEQ ID NO: 22491 - protein, 469 aa, Artificial Sequence; identical to SEQ ID NO: 16738
  neuraminidase__InfluenzaA__AFK74628

SEQ ID NO: 22492 - protein, 469 aa, Artificial Sequence; identical to SEQ ID NO: 16738
  neuraminidase__InfluenzaA__AFK74638

SEQ ID NO: 22493 - protein, 469 aa, Artificial Sequence; identical to SEQ ID NO: 16738
  neuraminidase__InfluenzaA__AFK74648

SEQ ID NO: 22494 - protein, 469 aa, Artificial Sequence; identical to SEQ ID NO: 21862
  neuraminidase__InfluenzaA__AFK74658

SEQ ID NO: 22495 - protein, 469 aa, Artificial Sequence; identical to SEQ ID NO: 21862
  neuraminidase__InfluenzaA__AFK74668

SEQ ID NO: 22496 - protein, 469 aa, Artificial Sequence; identical to SEQ ID NO: 16738
  neuraminidase__InfluenzaA__AFK74678

SEQ ID NO: 22497 - protein, 469 aa, Artificial Sequence; identical to SEQ ID NO: 16738
  neuraminidase__InfluenzaA__AFK74688

SEQ ID NO: 22498 - protein, 469 aa, Artificial Sequence; identical to SEQ ID NO: 16738
  neuraminidase__InfluenzaA__AFK74698

SEQ ID NO: 22499 - protein, 469 aa, Artificial Sequence; identical to SEQ ID NO: 21869
  neuraminidase__InfluenzaA__AFK74708

SEQ ID NO: 22500 - protein, 469 aa, Artificial Sequence; identical to SEQ ID NO: 19730
  neuraminidase__InfluenzaA__AFK74718

SEQ ID NO: 22501 - protein, 469 aa, Artificial Sequence; identical to SEQ ID NO: 16738
  neuraminidase__InfluenzaA__AFK74728

SEQ ID NO: 22502 - protein, 469 aa, Artificial Sequence; identical to SEQ ID NO: 16738
  neuraminidase__InfluenzaA__AFK74738

SEQ ID NO: 22503 - protein, 469 aa, Artificial Sequence; identical to SEQ ID NO: 16738
  neuraminidase__InfluenzaA__AFK74748

SEQ ID NO: 22504 - protein, 469 aa, Artificial Sequence; identical to SEQ ID NO: 16738
  neuraminidase__InfluenzaA__AFK74758

SEQ ID NO: 22505 - protein, 469 aa, Artificial Sequence; identical to SEQ ID NO: 16738
  neuraminidase__InfluenzaA__AFK74768

SEQ ID NO: 22506 - protein, 469 aa, Artificial Sequence; identical to SEQ ID NO: 16738
  neuraminidase__InfluenzaA__AFK74778

SEQ ID NO: 22507 - protein, 469 aa, Artificial Sequence; identical to SEQ ID NO: 19730
  neuraminidase__InfluenzaA__AFK74788

SEQ ID NO: 22508 - protein, 469 aa, Artificial Sequence; identical to SEQ ID NO: 19730
  neuraminidase__InfluenzaA__AFK74798

SEQ ID NO: 22509 - protein, 469 aa, Artificial Sequence; identical to SEQ ID NO: 19730
  neuraminidase__InfluenzaA__AFK74808

SEQ ID NO: 22510 - protein, 469 aa, Artificial Sequence; identical to SEQ ID NO: 19730
  neuraminidase__InfluenzaA__AFK74818

SEQ ID NO: 22511 - protein, 469 aa, Artificial Sequence; identical to SEQ ID NO: 16738
  neuraminidase__InfluenzaA__AFK74828

SEQ ID NO: 22512 - protein, 469 aa, Artificial Sequence; identical to SEQ ID NO: 18629
  neuraminidase__InfluenzaA__AFK74838

SEQ ID NO: 22513 - protein, 469 aa, Artificial Sequence; identical to SEQ ID NO: 16738
  neuraminidase__InfluenzaA__AFK74848

SEQ ID NO: 22514 - protein, 469 aa, Artificial Sequence; identical to SEQ ID NO: 16738
  neuraminidase__InfluenzaA__AFK74898

SEQ ID NO: 22515 - protein, 469 aa, Artificial Sequence; identical to SEQ ID NO: 16738
  neuraminidase__InfluenzaA__AFK74908

SEQ ID NO: 22516 - protein, 469 aa, Artificial Sequence; identical to SEQ ID NO: 16738
  neuraminidase__InfluenzaA__AFK74918

SEQ ID NO: 22517 - protein, 469 aa, Artificial Sequence; identical to SEQ ID NO: 16738
  neuraminidase__InfluenzaA__AFK74928

SEQ ID NO: 22518 - protein, 469 aa, Artificial Sequence
  neuraminidase__InfluenzaA__AFK74938
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDNTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22519 - protein, 469 aa, Artificial Sequence; identical to SEQ ID NO: 16738
  neuraminidase__InfluenzaA__AFK74948

SEQ ID NO: 22520 - protein, 469 aa, Artificial Sequence; identical to SEQ ID NO: 18629
  neuraminidase__InfluenzaA__AFK74958

SEQ ID NO: 22521 - protein, 469 aa, Artificial Sequence; identical to SEQ ID NO: 19730
  neuraminidase__InfluenzaA__AFK74968

SEQ ID NO: 22522 - protein, 469 aa, Artificial Sequence; identical to SEQ ID NO: 16738
  neuraminidase__InfluenzaA__AFK74978

SEQ ID NO: 22523 - protein, 469 aa, Artificial Sequence; identical to SEQ ID NO: 18629
  neuraminidase__InfluenzaA__AFK74988

SEQ ID NO: 22524 - protein, 469 aa, Artificial Sequence; identical to SEQ ID NO: 16738
  neuraminidase__InfluenzaA__AFK74998

SEQ ID NO: 22525 - protein, 469 aa, Artificial Sequence; identical to SEQ ID NO: 19730
  neuraminidase__InfluenzaA__AFK75008

SEQ ID NO: 22526 - protein, 469 aa, Artificial Sequence; identical to SEQ ID NO: 16738
  neuraminidase__InfluenzaA__AFK75018

SEQ ID NO: 22527 - protein, 469 aa, Artificial Sequence; identical to SEQ ID NO: 16738
  neuraminidase__InfluenzaA__AFK75028

SEQ ID NO: 22528 - protein, 469 aa, Artificial Sequence; identical to SEQ ID NO: 16738
  neuraminidase__InfluenzaA__AFK75038

SEQ ID NO: 22529 - protein, 469 aa, Artificial Sequence; identical to SEQ ID NO: 16738
  neuraminidase__InfluenzaA__AFK75048

SEQ ID NO: 22530 - protein, 469 aa, Artificial Sequence; identical to SEQ ID NO: 16738
  neuraminidase__InfluenzaA__AFK75058

SEQ ID NO: 22531 - protein, 469 aa, Artificial Sequence; identical to SEQ ID NO: 19730
  neuraminidase__InfluenzaA__AFK75068

SEQ ID NO: 22532 - protein, 469 aa, Artificial Sequence; identical to SEQ ID NO: 16738
  neuraminidase__InfluenzaA__AFK75078

SEQ ID NO: 22533 - protein, 469 aa, Artificial Sequence; identical to SEQ ID NO: 16738
  neuraminidase__InfluenzaA__AFK75088

SEQ ID NO: 22534 - protein, 469 aa, Artificial Sequence; identical to SEQ ID NO: 16738
  neuraminidase__InfluenzaA__AFK75098

SEQ ID NO: 22535 - protein, 469 aa, Artificial Sequence; identical to SEQ ID NO: 18651
  neuraminidase__InfluenzaA__AFK75108

SEQ ID NO: 22536 - protein, 469 aa, Artificial Sequence; identical to SEQ ID NO: 16738
  neuraminidase__InfluenzaA__AFK77860

SEQ ID NO: 22537 - protein, 469 aa, Artificial Sequence; identical to SEQ ID NO: 16738
  neuraminidase__InfluenzaA__AFK77870

SEQ ID NO: 22538 - protein, 469 aa, Artificial Sequence; identical to SEQ ID NO: 16738
  neuraminidase__InfluenzaA__AFK77880

SEQ ID NO: 22539 - protein, 469 aa, Artificial Sequence
  neuraminidase__InfluenzaA__AFK77890
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKGISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22540 - protein, 469 aa, Artificial Sequence
  neuraminidase__InfluenzaA__AFK77900
MNPNQKIITIGSVCMTIGMANLILQIGNIISIWISHSIQIGNQNQIETCNQSVITYENNTWVNQTYVNISNTNFAAGQSVASVKLAGNSSLCPVSGWAIYSKDNSIRIGSKGDVFVIREPFISCSPLECRTFFLTQGALLNDKHSNGTIKDRSPYRALMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGMNEWSGYSGSFVQHPELTGLDCIRPCFWVELIRGRPKENTIWTSGSSISFCGVNSDTVGWSWPDGAELPFTIDK

SEQ ID NO: 22541 - protein, 469 aa, Artificial Sequence
  neuraminidase__InfluenzaA__AFK78031
MNPNQKIITIGSVCMTIGMANLILQIGNIISIWISHSIQLGNQNQIETCNQSVITYENNTWVNQTYVNISNTNFAAGQSVASVKLAGNSSLCPVSGWAIYSKDNSIRIGSKGDVFVIREPFISCSPLECRTFFLTQGALLNDKHSNGTIKDRSPYRALMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGMNEWSGYSGSFVQHPELTGLDCIRPCFWVELIRGRPKENTIWTSGSSISFCGVNSDTVGWSWPDGAELPFTIDK

SEQ ID NO: 22542 - protein, 469 aa, Artificial Sequence; identical to SEQ ID NO: 16738
  neuraminidase__InfluenzaA__AFK78190

SEQ ID NO: 22543 - protein, 453 aa, Artificial Sequence
  neuraminidase__InfluenzaA__AFM68957
MNPNQKIITIGSICMVVGIISLILQIGNIISIWISHSIQTGNQNHTGICNQGIITHNVVAGQDSTSVILTGNSSLCPIRGWAIHSKDNGIRIGSKGDVFVIREPFISCSHLECRTFFLTQGALLNDKHSYGTSKDRSPYRALMSCPVGEAPSPYNSRFESVAWSASACHDGMGWLTIGISGPDNGAVAVLKYNGIITETIKSWRKKILRTQESECTCVNGSCFTIMTDGPSDGLASYKIFKIEKGKVTKSIELNAPNSHYEECSCYPDTGKVMCVCRDNWHGSNRPWVSFDQNLDYQIGYICSGVFGDNPRPKDGTGSCGPVSADGANGVKGFSYRYGNGVWIGRTKSDSSRHGFEMIWDPNGWTETDSRFSVRQDVVAMTDRSGYSGSFVQHPELTGLDCMRPCFWVELIRGQPEEETIWTSGSIISFCGVNSDTVDWSWPDGAELPFTIDK

SEQ ID NO: 22544 - protein, 469 aa, Artificial Sequence
  neuraminidase__InfluenzaA__AFM68968
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIASSYVCSGLVGDTPRKNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 22545 - protein, 469 aa, Artificial Sequence
  neuraminidase__InfluenzaA__AFM68979
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGGIWVTREPYVSCDPGKCYQFALGQGTTLDNKHSNDTIHDRTPYRTLLMNELGVPFHLGTRQVCIAWSSSSCHDGKAWLHVCVTGYDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPVVDINVKDYSIVSSYVCSGLVGDTPRKNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 22546 - protein, 469 aa, Artificial Sequence; identical to SEQ ID NO: 22545
  neuraminidase__InfluenzaA__AFM68990

SEQ ID NO: 22547 - protein, 469 aa, Artificial Sequence; identical to SEQ ID NO: 14813
  neuraminidase__InfluenzaA__AFM71723

SEQ ID NO: 22548 - protein, 469 aa, Artificial Sequence; identical to SEQ ID NO: 22135
  neuraminidase__InfluenzaA__AFM71734

SEQ ID NO: 22549 - protein, 469 aa, Artificial Sequence; identical to SEQ ID NO: 21949
  neuraminidase__InfluenzaA__AFM71745

SEQ ID NO: 22550 - protein, 469 aa, Artificial Sequence; identical to SEQ ID NO: 18609
  neuraminidase__InfluenzaA__AFM71771

SEQ ID NO: 22551 - protein, 469 aa, Artificial Sequence; identical to SEQ ID NO: 21635
  neuraminidase__InfluenzaA__AFM71782

SEQ ID NO: 22552 - protein, 469 aa, Artificial Sequence; identical to SEQ ID NO: 21635
  neuraminidase__InfluenzaA__AFM71794

SEQ ID NO: 22553 - protein, 469 aa, Artificial Sequence; identical to SEQ ID NO: 16599
  neuraminidase__InfluenzaA__AFM71805

SEQ ID NO: 22554 - protein, 469 aa, Artificial Sequence
  neuraminidase__InfluenzaA__AFM71827
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGKDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22555 - protein, 469 aa, Artificial Sequence; identical to SEQ ID NO: 19518
  neuraminidase__InfluenzaA__AFM71838

SEQ ID NO: 22556 - protein, 454 aa, Artificial Sequence; identical to SEQ ID NO: 15719
  neuraminidase__InfluenzaA__AFM71849

SEQ ID NO: 22557 - protein, 469 aa, Artificial Sequence; identical to SEQ ID NO: 14095
  neuraminidase__InfluenzaA__AFM71860

SEQ ID NO: 22558 - protein, 469 aa, Artificial Sequence; identical to SEQ ID NO: 14327
  neuraminidase__InfluenzaA__AFM71871

SEQ ID NO: 22559 - protein, 469 aa, Artificial Sequence; identical to SEQ ID NO: 14327
  neuraminidase__InfluenzaA__AFM71882

SEQ ID NO: 22560 - protein, 469 aa, Artificial Sequence
  neuraminidase__InfluenzaA__AFM71893
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTINKESRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 22561 - protein, 469 aa, Artificial Sequence
  neuraminidase__InfluenzaA__AFM71904
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNVTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSGYVCSGLVGDTPRNDDSSSNSNCRDPNNERGNPGVKGWAFDNGDDVWMGRTINKESRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 22562 - protein, 469 aa, Artificial Sequence; identical to SEQ ID NO: 14972
  neuraminidase__InfluenzaA__AFM71915

SEQ ID NO: 22563 - protein, 469 aa, Artificial Sequence; identical to SEQ ID NO: 14972
  neuraminidase__InfluenzaA__AFM71926

SEQ ID NO: 22564 - protein, 469 aa, Artificial Sequence; identical to SEQ ID NO: 14972
  neuraminidase__InfluenzaA__AFM71937

SEQ ID NO: 22565 - protein, 469 aa, Artificial Sequence; identical to SEQ ID NO: 21980
  neuraminidase__InfluenzaA__AFM71948

SEQ ID NO: 22566 - protein, 469 aa, Artificial Sequence; identical to SEQ ID NO: 21980
  neuraminidase__InfluenzaA__AFM71959

SEQ ID NO: 22567 - protein, 469 aa, Artificial Sequence
  neuraminidase__InfluenzaA__AFM71970
MNPNQKIITIGSVSLTIATICFLMQIAILVTTVTLHFKQYECDSPANNQVMPYEPIIIERNITEIVYLTNTTIEKEICPKLVEYRNWSKPQCKITGFAPFSKDNSIRLSAGGDIWVTREPYVSCDPGKCYQFALGQGTTLENKHSNDTIHDRTPHRTLLMNELGVPFHLGTRQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRKNDRSSSSYCRNPNNEKGNHGVKGWAFDDGNDVWMGRTISEDSRSGYETFKVIGGWSTPNSKLQINRQVIVDSANRSGYSGIFSVEGKSCINRCFYVELIRGREQETRVWWTSNSIVVFCGTSGTYGTGSWPDGADINLMPI

SEQ ID NO: 22568 - protein, 469 aa, Artificial Sequence; identical to SEQ ID NO: 21988
  neuraminidase__InfluenzaA__AFM71981

SEQ ID NO: 22569 - protein, 469 aa, Artificial Sequence
  neuraminidase__InfluenzaA__AFM71992
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSQEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQMNRQVIVDRGNRSGYSGIFSVEGKSCINRCFYVELIRGRKEETEVLWTSNSIVVFCGTSGTYGTGSWPDGADLNLMPI

SEQ ID NO: 22570 - protein, 469 aa, Artificial Sequence; identical to SEQ ID NO: 22544
  neuraminidase__InfluenzaA__AFM72013

SEQ ID NO: 22571 - protein, 454 aa, Artificial Sequence; identical to SEQ ID NO: 15719
  neuraminidase__InfluenzaA__AFM72024

SEQ ID NO: 22572 - protein, 469 aa, Artificial Sequence; identical to SEQ ID NO: 18995
  neuraminidase__InfluenzaA__AFM72035

SEQ ID NO: 22573 - protein, 469 aa, Artificial Sequence; identical to SEQ ID NO: 18995
  neuraminidase__InfluenzaA__AFM72046

SEQ ID NO: 22574 - protein, 470 aa, Artificial Sequence
  neuraminidase__InfluenzaA__AFM72057
MNPNQKIITIGSICTTIGIISLILQIGNIISIWVSHSIQTGSQNHTGICNQRIITYENSTWVNQTYVNINNTNVVAGKDTTSVTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRKRILRTQESECVCVNGSCFTIMTDGPSNGPASYRIFKIEKGKITKSIELDAPNSHYEECSCYPDTGTVMCVCRDNWHGSNRPWVSFNQNLDYQIGYICSGVFGDNPRPKDGKGSCDPVTVDGADGVKGFSYRYGNGVWIGRTKSNSSRKGFEMIWDPNGWTDTDSNFLVKQDVVAMTDWSGYSGSFVQHPELTGLDCMRPCFWVELIRGRPREKTTIWTSGSSISFCGVNSDTANWSWPDGAELPFTIDK

SEQ ID NO: 22575 - protein, 470 aa, Artificial Sequence; identical to SEQ ID NO: 15059
  neuraminidase__InfluenzaA__AFM72068

SEQ ID NO: 22576 - protein, 469 aa, Artificial Sequence
  neuraminidase__InfluenzaA__AFM72090
MNPNQKIITIGSVSLTIATICFLMQIAILVTTVTLHFKQYECSSPPNNQVMPCEPIIIERNITEIVYLTNTTIEKEICPKLVEYRNWSKPQCKITGFAPFSKDNSIRLSAGGDIWVTREPYVSCDPGKCYQFALGQGTTLNNKHSNDTVHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGNHGVKGWAFDDGNDVWMGRTIGEELRLGYETFKVIGGWSTPNSKLQINRQVIVDSKNRSGYSGIFSVEGKSCINRCFYVELIRGREQETRVWWTSNSIVVFCGTSGTYGTGSWPDGADINLMPI

SEQ ID NO: 22577 - protein, 469 aa, Artificial Sequence
  neuraminidase__InfluenzaA__AFM72101
MNPNQKIITIGSVSLTIATICFLMQIAILVTTVTLHFKQYECSSPPNNQAMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGREQETRVWWTSNSIVVFCGTSGTYGTGSWPDGADINLMPI

SEQ ID NO: 22578 - protein, 469 aa, Artificial Sequence; identical to SEQ ID NO: 14813
  neuraminidase__InfluenzaA__AFM72112

SEQ ID NO: 22579 - protein, 469 aa, Artificial Sequence
  neuraminidase__InfluenzaA__AFM72123
MNPNQKIITIGSVSLTIATICFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQTNRQVIVDSGNRSGYSGIFSVEGKSCINRCFYVELIRGREQETRVWWTSNSIVVFCGTSGTYGTGSWPDGADINLMPI

SEQ ID NO: 22580 - protein, 469 aa, Artificial Sequence; identical to SEQ ID NO: 22135
  neuraminidase__InfluenzaA__AFM72134

SEQ ID NO: 22581 - protein, 469 aa, Artificial Sequence
  neuraminidase__InfluenzaA__AFM72145
MNPNQKIITIGSVSLTIATICFLMQIAILAITVTLHFKQYECNSPPNNQVMLCEPTIIERNTTEIVYLTNTTIEKEVCPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22582 - protein, 469 aa, Artificial Sequence; identical to SEQ ID NO: 15185
  neuraminidase__InfluenzaA__AFM72156

SEQ ID NO: 22583 - protein, 469 aa, Artificial Sequence
  neuraminidase__InfluenzaA__AFM72167
MNPNQKIITIGSISLTIATICFLMQIAILVTTVTLHFKQYECNSPPNNQVMLCEPTIIERNITEIVYLTNTTIEKEICPELAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22584 - protein, 469 aa, Artificial Sequence
  neuraminidase__InfluenzaA__AFM72178
MNPNQKIITIGSVSLTIATICFLMQIAILVTTVTLHFKQYECNSPPNNQVMLCEPTIIERNITEIVYLTNTTIEKEICPELAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCWNPNNEKGGHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22585 - protein, 469 aa, Artificial Sequence
  neuraminidase__InfluenzaA__AFM72189
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPDKCYQFALGQGTTLNNRHSNDTVHDRTPYRTLLMNELGVPFHLGTKQVCIAWSSSSCHDGKAWLHVCVTGHDENATASFIYDGRLVDSIGSWSKKILRTQESECVCINGTCTVVMTDGSASGRADTKILFIEEGKIVHISPLLGSAQHVEECSCYPRYPGVRCVCRDNWKGSNRPIVDINVKDYSIVSSYVCSGLVGDTPRKNDSSSSSHCLNPNNEEGGHGVKGWAFDDGDDVWMGRTISEKLRSGYETFKVIEGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22586 - protein, 469 aa, Artificial Sequence; identical to SEQ ID NO: 22585
  neuraminidase__InfluenzaA__AFM72200

SEQ ID NO: 22587 - protein, 469 aa, Artificial Sequence; identical to SEQ ID NO: 15749
  neuraminidase__InfluenzaA__AFM72211

SEQ ID NO: 22588 - protein, 469 aa, Artificial Sequence; identical to SEQ ID NO: 15749
  neuraminidase__InfluenzaA__AFM72222

SEQ ID NO: 22589 - protein, 470 aa, Artificial Sequence; identical to SEQ ID NO: 16453
  neuraminidase__InfluenzaA__AFM72233

SEQ ID NO: 22590 - protein, 469 aa, Artificial Sequence; identical to SEQ ID NO: 14573
  neuraminidase__InfluenzaA__AFM72249

SEQ ID NO: 22591 - protein, 469 aa, Artificial Sequence; identical to SEQ ID NO: 14061
  neuraminidase__InfluenzaA__AFM72260

SEQ ID NO: 22592 - protein, 469 aa, Artificial Sequence; identical to SEQ ID NO: 14061
  neuraminidase__InfluenzaA__AFM72271

SEQ ID NO: 22593 - protein, 469 aa, Artificial Sequence
  neuraminidase__InfluenzaA__AFM72293
MNPNQKIITIGSVSLTIATICFLMQIAILVTTVTLHFKQYECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNYTVHDRTPYRTLLMNELGVPFHLGTKQVCIAWSSSSCHDGKAWLHVCVTGDDENATASFIYNGRLVDSIGSWSKKILRTQESECVCINGTCTVVMTDGSASGKADTKILFIEEGKIVHTSSLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRKQETEVLWTSNSIVVFCGTSGTYGTGSWPDGADINLMPI

SEQ ID NO: 22594 - protein, 469 aa, Artificial Sequence; identical to SEQ ID NO: 15929
  neuraminidase__InfluenzaA__AFM72304

SEQ ID NO: 22595 - protein, 469 aa, Artificial Sequence
  neuraminidase__InfluenzaA__AFM72315
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEKGGHGVKGWAFDDGNDVWMGRTISEKLRSGYETFKVIEGWSNPNSKLQINRQVIVDRDNRSGYSGIFSVEGKSCINRCFYVELIRGRNQETEVLWTSNSIVVFCGTSGTYGTGSWPDGADINLMPI

SEQ ID NO: 22596 - protein, 469 aa, Artificial Sequence
  neuraminidase__InfluenzaA__AFM72326
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKFQINRQVIVDRDNRSGYSGIFSVEGKSCINRCFYVELIRGRNQETEVLWTSNSIVVFCGTSGTYGTGSWPDGADINLMPI

SEQ ID NO: 22597 - protein, 469 aa, Artificial Sequence
  neuraminidase__InfluenzaA__AFM72337
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 22598 - protein, 469 aa, Artificial Sequence
  neuraminidase__InfluenzaA__AFM72348
MNPNQKIITIGSVSLTIATICFLMQIAILVTTVTLHFKQHECNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGIPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 22599 - protein, 469 aa, Artificial Sequence
  neuraminidase__InfluenzaA__AFM72359
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETKVLWTSNSIVVFCGTSGTYGTGSWPDGADINLMPI

SEQ ID NO: 22600 - protein, 469 aa, Artificial Sequence; identical to SEQ ID NO: 22599
  neuraminidase__InfluenzaA__AFM72370

SEQ ID NO: 22601 - protein, 469 aa, Artificial Sequence; identical to SEQ ID NO: 19518
  neuraminidase__InfluenzaA__AFM72381

SEQ ID NO: 22602 - protein, 469 aa, Artificial Sequence; identical to SEQ ID NO: 19518
  neuraminidase__InfluenzaA__AFM72392

SEQ ID NO: 22603 - protein, 469 aa, Artificial Sequence; identical to SEQ ID NO: 16402
  neuraminidase__InfluenzaA__AFM72403

SEQ ID NO: 22604 - protein, 469 aa, Artificial Sequence; identical to SEQ ID NO: 16402
  neuraminidase__InfluenzaA__AFM72414

SEQ ID NO: 22605 - protein, 469 aa, Artificial Sequence; identical to SEQ ID NO: 16066
  neuraminidase__InfluenzaA__AFM72425

SEQ ID NO: 22606 - protein, 469 aa, Artificial Sequence; identical to SEQ ID NO: 16066
  neuraminidase__InfluenzaA__AFM72436

SEQ ID NO: 22607 - protein, 469 aa, Artificial Sequence; identical to SEQ ID NO: 16066
  neuraminidase__InfluenzaA__AFM72447

SEQ ID NO: 22608 - protein, 469 aa, Artificial Sequence; identical to SEQ ID NO: 16066
  neuraminidase__InfluenzaA__AFM72458

SEQ ID NO: 22609 - protein, 469 aa, Artificial Sequence; identical to SEQ ID NO: 16066
  neuraminidase__InfluenzaA__AFM72469

SEQ ID NO: 22610 - protein, 469 aa, Artificial Sequence
  neuraminidase__InfluenzaA__AFM72491
MNPNQKIITIGSVSLTISTICFFMQIAILITTVTLHFKQYEFNSPPNNQVMMCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 22611 - protein, 469 aa, Artificial Sequence; identical to SEQ ID NO: 22610
  neuraminidase__InfluenzaA__AFM72502

SEQ ID NO: 22612 - protein, 470 aa, Artificial Sequence; identical to SEQ ID NO: 16632
  neuraminidase__InfluenzaA__AFM72513

SEQ ID NO: 22613 - protein, 470 aa, Artificial Sequence; identical to SEQ ID NO: 16632
  neuraminidase__InfluenzaA__AFM72524

SEQ ID NO: 22614 - protein, 470 aa, Artificial Sequence; identical to SEQ ID NO: 16632
  neuraminidase__InfluenzaA__AFM72535

SEQ ID NO: 22615 - protein, 470 aa, Artificial Sequence; identical to SEQ ID NO: 16632
  neuraminidase__InfluenzaA__AFM72546

SEQ ID NO: 22616 - protein, 470 aa, Artificial Sequence; identical to SEQ ID NO: 16632
  neuraminidase__InfluenzaA__AFM72557

SEQ ID NO: 22617 - protein, 469 aa, Artificial Sequence
  neuraminidase__InfluenzaA__AFM72579
MNPNQKIITIGSVSLTISTICFFMQTAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSILSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22618 - protein, 470 aa, Artificial Sequence
  neuraminidase__InfluenzaA__AFM72802
MNPNQKIITIGSISIAIGIISLMLQIGNIISIWASHSIQTGSQNHTGMCNQRIITYENSTWVNHTYVNINNTNVVAGKDKTPVTLAGNSSLCSISGWAIHTKDNSIRIGSKGDVFVIREPFISCSHLECKTFFLTQGALLNDKHSNGTVKDRSPYRALMSCPLGEAPSPYNSKFESVAWSASACHDGIGWLTIGISGPDNGAVAVLKYNGIITGTIKSWKKQILRTQESECVCMNGSCFTIMTDGPSNGAASYKIFKIEKGKVIKSMELNAPNFHYEECSCYPDTGTVMCVCRDNWHGSNRPWVSFNQNLDYQIGYICSGVFGDNPRPEDGEGSCNPVTVDGANGVKGFSYKYGNGVWIGRTKSNRIRKGFEMIWDPNGWTNTDSDFSVKQDIVAITDWSGYSGSFVQHPELTGLDCIRPCFWVELVRGLPRENTTIWTSGSSISFCGVNSDIANWSWPDGAELPFTIDK

SEQ ID NO: 22619 - protein, 470 aa, Artificial Sequence; identical to SEQ ID NO: 22618
  neuraminidase__InfluenzaA__AFM72813

SEQ ID NO: 22620 - protein, 470 aa, Artificial Sequence; identical to SEQ ID NO: 22618
  neuraminidase__InfluenzaA__AFM72824

SEQ ID NO: 22621 - protein, 469 aa, Artificial Sequence; identical to SEQ ID NO: 16728
  neuraminidase__InfluenzaA__AFM72835

SEQ ID NO: 22622 - protein, 469 aa, Artificial Sequence; identical to SEQ ID NO: 16728
  neuraminidase__InfluenzaA__AFM72845

SEQ ID NO: 22623 - protein, 469 aa, Artificial Sequence; identical to SEQ ID NO: 16728
  neuraminidase__InfluenzaA__AFM72855

SEQ ID NO: 22624 - protein, 469 aa, Artificial Sequence; identical to SEQ ID NO: 16728
  neuraminidase__InfluenzaA__AFM72865

SEQ ID NO: 22625 - protein, 469 aa, Artificial Sequence
  neuraminidase__InfluenzaA__AFM72875
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKSDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 22626 - protein, 469 aa, Artificial Sequence; identical to SEQ ID NO: 16599
  neuraminidase__InfluenzaA__AFM72886

SEQ ID NO: 22627 - protein, 469 aa, Artificial Sequence; identical to SEQ ID NO: 16599
  neuraminidase__InfluenzaA__AFM72897

SEQ ID NO: 22628 - protein, 469 aa, Artificial Sequence
  neuraminidase__InfluenzaA__AFM72908
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINTKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 22629 - protein, 469 aa, Artificial Sequence
  neuraminidase__InfluenzaA__AFM72919
MNPNQKIITIGSVSLTISTICFFMQIAILITTVTLHFKQHEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINTKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPV

SEQ ID NO: 22630 - protein, 469 aa, Artificial Sequence; identical to SEQ ID NO: 17905
  neuraminidase__InfluenzaA__AFM72930

SEQ ID NO: 22631 - protein, 469 aa, Artificial Sequence; identical to SEQ ID NO: 17905
  neuraminidase__InfluenzaA__AFM72941

SEQ ID NO: 22632 - protein, 469 aa, Artificial Sequence; identical to SEQ ID NO: 17905
  neuraminidase__InfluenzaA__AFM72952

SEQ ID NO: 22633 - protein, 469 aa, Artificial Sequence; identical to SEQ ID NO: 17905
  neuraminidase__InfluenzaA__AFM72963

SEQ ID NO: 22634 - protein, 469 aa, Artificial Sequence; identical to SEQ ID NO: 17905
  neuraminidase__InfluenzaA__AFM72974

SEQ ID NO: 22635 - protein, 469 aa, Artificial Sequence; identical to SEQ ID NO: 19518
  neuraminidase__InfluenzaA__AFM72985

SEQ ID NO: 22636 - protein, 469 aa, Artificial Sequence; identical to SEQ ID NO: 19518
  neuraminidase__InfluenzaA__AFM72996

SEQ ID NO: 22637 - protein, 469 aa, Artificial Sequence; identical to SEQ ID NO: 19518
  neuraminidase__InfluenzaA__AFM73007

SEQ ID NO: 22638 - protein, 469 aa, Artificial Sequence
  neuraminidase__InfluenzaA__AFM73018
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGIWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22639 - protein, 469 aa, Artificial Sequence; identical to SEQ ID NO: 22638
  neuraminidase__InfluenzaA__AFM73028

SEQ ID NO: 22640 - protein, 469 aa, Artificial Sequence; identical to SEQ ID NO: 22638
  neuraminidase__InfluenzaA__AFM73038

SEQ ID NO: 22641 - protein, 469 aa, Artificial Sequence; identical to SEQ ID NO: 18473
  neuraminidase__InfluenzaA__AFM73048

SEQ ID NO: 22642 - protein, 469 aa, Artificial Sequence
  neuraminidase__InfluenzaA__AFM73058
MNPNQKIITIGSFCMTIGLANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDKNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22643 - protein, 469 aa, Artificial Sequence; identical to SEQ ID NO: 18473
  neuraminidase__InfluenzaA__AFM73068

SEQ ID NO: 22644 - protein, 470 aa, Artificial Sequence; identical to SEQ ID NO: 14951
  neuraminidase__InfluenzaA__AFM73480

SEQ ID NO: 22645 - protein, 449 aa, Artificial Sequence
  neuraminidase__InfluenzaA__AFM78569
MNPNQKIITIGSICMVIGIVSLMLQIGNMISIWVIHSIQTGNQHQAESISNTNPLTEKAVASVTLAGNSSLCPIRGWAVHSKDNNIRIGSKGDVFVIREPFISCSHLECRTFFLTQGALLNDKHSNGTVKDRSPHRTLMSCPVGEAPSPYNSRFESVAWSASACHDGTSWLTIGISGPDNEAVAVLKYNGIITDTIKSWRNDILRTQESECACVNGSCFTVMTDGPSNGQASYKIFKMEKGKVVKSVELDAPNYHYEECSCYPDAGEITCVCRDNWHGSNRPWVSFNQNLEYQIGYICSGVFGDNPRPNDGTGSCGPMSPNGAYGVKGFSFKYGNGVWIGRTKSTNSRSGFEMIWDPNGWTGTDSSFSVKQDIVAITDWSGYSGSFVQHPELTGLDCIRPCFWVELIRGRPKESTIWTSGSSISFCGVNSDTVSWSWPDGAELPFTIDK

SEQ ID NO: 22646 - protein, 469 aa, Artificial Sequence
  neuraminidase__InfluenzaA__AFM85180
MNPNQKIITIGSVSLTIATICFLTQIAILVTTVTLHFKQYECNSSPNNQVMLCEPTIIERNITEIVYLTNTTIEKEICPKLAEYRNWSKPQCNITGFAPFSKDNSIRLSAGGDIWVTREPYVSCGPDKCYQFALGQGTTLNNGHSNDTVHDRTPYRTLLMNELGVPFHLGTKQVCIAWSSSSCHDGKAWLHVCVTGDDKNATASFIYNGRLVDSIGSWSKKILRTQESECVCINGTCTVVMTDGSASGKADTKILFIEEGKIVHTSLLSGSAQHVEECSCYPRYPGVRCVCRDNWKGSNRPIVDINVKDYSIVSSYVCSGLVGDTPRKNDSSSSSHCLDPNNEEGGHGVKGWAFDDGNDVWMGRTISEKLRSGYETFKVIEGWSKPNSKLQINRQVIVDRGNRSGYSGIFSVEGKSCINRCFYVELIRGRNQETEVLWTSNSIVVFCGTSGTYGTGSWPDGADINLMPI

SEQ ID NO: 22647 - protein, 469 aa, Artificial Sequence; identical to SEQ ID NO: 14103
  neuraminidase__InfluenzaA__AFN11830

SEQ ID NO: 22648 - protein, 469 aa, Artificial Sequence
  neuraminidase__InfluenzaA__AFN11831
MNPNQKIITIGSVSLTIATICFLMQIAILVTTVTLHFKQYECDSPANNQVMPCEPIIIERNITEIVYLTNTTIEKEICPKLVEYRNWSKPQCKITGFAPFSKDNSIRLSAGGDIWVTREPYVSCDPGKCYQFALGQGTTLDNKHSNDTIHDRTPHRTLLMNELGVPFHLGTRQVCIAWSSSSCHDGKAWLHVCVTGYDKNATASFIYDGRLVDSIGSWSKNILRTQESECVCINGTCTVVMTDGSASGRADTKILFIEEGKIVHISPLSGSAQHVEECSCYPRYPGVRCVCRDNWKGSNRPVVDINVKDYSIVSSYVCSGLVGDTPRNNDRSSSSYCRNPNNEKGNHGVKGWAFDDGNDVWMGRTISEESRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 22649 - protein, 469 aa, Artificial Sequence; identical to SEQ ID NO: 14576
  neuraminidase__InfluenzaA__AFN11833

SEQ ID NO: 22650 - protein, 469 aa, Artificial Sequence; identical to SEQ ID NO: 16511
  neuraminidase__InfluenzaA__AFN11835

SEQ ID NO: 22651 - protein, 469 aa, Artificial Sequence
  neuraminidase__InfluenzaA__AFN11836
MNPNQKIITIGSVSLTIATMCFLMQIAILVTTVTLHFKQYECSSPPNNQVMPCEPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDKNATASFIYDGRLVDSIGSWSKNILRTQESECVCINGTCTVVMTDGSASERADTKILFIEEGKIIHISPLSGSAQHVEECSCYPRYPGVRCVCRDNWKGSNRPIVDINVKDYSIVSSYVCSGLVGDTPRKNDRSSSSYCRNPNNEKGSHGVKGWAFDDGNDVWMGRTIGEELRSGYETFKVIGGWSTPNSKLQINRQVIVDSGNRSGYSGIFSVEGKSCINRCFYVELIRGREQETRVWWTSNSIVVFCGTSGTYGTGSWPDGADINLMPI

SEQ ID NO: 22652 - protein, 469 aa, Artificial Sequence
  neuraminidase__InfluenzaA__AFN11839
MNPNQKIITIGSVSLTIATICFLMQIAILVTTVTLHFKQYECSSPPNNQVMPCQPTIIERNITEIVYLTNTTIEKEICPKLVEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINMKDYSIVSSYVCSGLVGDTPRKNDSSSSSYCRNPNNEKGSHGVKGWAFDDGNDVWMGRTISEELRSGYETFKVIGGWSTPNSKLQINRQVIVDSGNRSGYSGIFSVEGKSCINRCFYVELIRGRKQETKVWWTSNSIVVFCGTSGTYGTGSWPDGADINLMPI

SEQ ID NO: 22653 - protein, 469 aa, Artificial Sequence
  neuraminidase__InfluenzaA__AFN11840
MNPNQKIITIGSVSLTIATICFLMQIAILVTTVTLHFKQYECNSPPNNQVMLCEPTIIERNITEIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTIGEELRSGYETFKVIGGWSTPNSKLQINRQVIVDRGNRSGYSGIFSVEGKSCINRCFYVELVRGRKQETEVWWTSNSIVVFCGTSGTYGTGSWPDGADINLMPI

SEQ ID NO: 22654 - protein, 469 aa, Artificial Sequence; identical to SEQ ID NO: 15929
  neuraminidase__InfluenzaA__AFN11841

SEQ ID NO: 22655 - protein, 469 aa, Artificial Sequence; identical to SEQ ID NO: 22017
  neuraminidase__InfluenzaA__AFN11842

SEQ ID NO: 22656 - protein, 469 aa, Artificial Sequence
  neuraminidase__InfluenzaA__AFN11844
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADIGLMPM

SEQ ID NO: 22657 - protein, 469 aa, Artificial Sequence; identical to SEQ ID NO: 22576
  neuraminidase__InfluenzaA__AFN11845

SEQ ID NO: 22658 - protein, 469 aa, Artificial Sequence; identical to SEQ ID NO: 22104
  neuraminidase__InfluenzaA__AFN11847

SEQ ID NO: 22659 - protein, 469 aa, Artificial Sequence
  neuraminidase__InfluenzaA__AFN11848
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLGPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 22660 - protein, 469 aa, Artificial Sequence
  neuraminidase__InfluenzaA__AFN11850
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRGRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNHKSKLQINRQVIVDRGNRSGYSGIFSVEGKSCINRCFYVELIRGRKEETEVLWTSNSIVVFCGTSGTYGTGSWPDGADLNLMPI

SEQ ID NO: 22661 - protein, 469 aa, Artificial Sequence
  neuraminidase__InfluenzaA__AFN11851
MNPNQKIITIGSVSLTIATICLLMQIAILVTTVTLHFKQYECNSPPNNQVMLCEPTIIERNITKIVYLTNTTIEKEICPKLAEYRNWSKPQCKITGFAPFSKDNSIRLSAGGDIWVTREPYVSCDPGKCYQFALGQGTTLNNRHSNDTVHDRTPYRTLLMNELGVPFHLGTKQVCIAWSSSSCHDGKAWLHVCVTGHDENATASFIYDGRLVDSIGSWSKNILRTQESECVCINGTCTVVMTDGSASERADTKILFIEEGKIVHISPLSGSAQHVEECSCYPRYPGVRCVCRDNWKGSNRPIVDINVKDYSIVSSYVCSGLVGDTPRKNDSSSSSYCRNPNNEKGSHGVKGWAFDDGNDVWMGRTISEELRSGYETFKVIGGWSKPNSKLQINRQVIVDRGNRSGYSGIFSVEGKSCINRCFYVELIRGRKQETEVWWTSNSIVVFCGTSGTYGTGSWPDGADINLMPI

SEQ ID NO: 22662 - protein, 469 aa, Artificial Sequence; identical to SEQ ID NO: 14327
  neuraminidase__InfluenzaA__AFN11853

SEQ ID NO: 22663 - protein, 469 aa, Artificial Sequence
  neuraminidase__InfluenzaA__AFN11855
MNPNQKIITIGSVSLTISTICFFMQTAILITIVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSILSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 22664 - protein, 469 aa, Artificial Sequence; identical to SEQ ID NO: 15929
  neuraminidase__InfluenzaA__AFN11857

SEQ ID NO: 22665 - protein, 469 aa, Artificial Sequence; identical to SEQ ID NO: 16738
  neuraminidase__InfluenzaA__AFN17373

SEQ ID NO: 22666 - protein, 469 aa, Artificial Sequence; identical to SEQ ID NO: 22371
  neuraminidase__InfluenzaA__AFN17383

SEQ ID NO: 22667 - protein, 469 aa, Artificial Sequence; identical to SEQ ID NO: 16738
  neuraminidase__InfluenzaA__AFN17393

SEQ ID NO: 22668 - protein, 469 aa, Artificial Sequence; identical to SEQ ID NO: 16738
  neuraminidase__InfluenzaA__AFN17403

SEQ ID NO: 22669 - protein, 469 aa, Artificial Sequence; identical to SEQ ID NO: 16738
  neuraminidase__InfluenzaA__AFN17413

SEQ ID NO: 22670 - protein, 469 aa, Artificial Sequence; identical to SEQ ID NO: 16738
  neuraminidase__InfluenzaA__AFN17423

SEQ ID NO: 22671 - protein, 469 aa, Artificial Sequence; identical to SEQ ID NO: 16738
  neuraminidase__InfluenzaA__AFN17433

SEQ ID NO: 22672 - protein, 469 aa, Artificial Sequence; identical to SEQ ID NO: 16738
  neuraminidase__InfluenzaA__AFN17443

SEQ ID NO: 22673 - protein, 469 aa, Artificial Sequence; identical to SEQ ID NO: 16738
  neuraminidase__InfluenzaA__AFN17453

SEQ ID NO: 22674 - protein, 469 aa, Artificial Sequence; identical to SEQ ID NO: 16738
  neuraminidase__InfluenzaA__AFN17459

SEQ ID NO: 22675 - protein, 469 aa, Artificial Sequence; identical to SEQ ID NO: 16738
  neuraminidase__InfluenzaA__AFN17469

SEQ ID NO: 22676 - protein, 469 aa, Artificial Sequence; identical to SEQ ID NO: 16738
  neuraminidase__InfluenzaA__AFN17479

SEQ ID NO: 22677 - protein, 469 aa, Artificial Sequence; identical to SEQ ID NO: 16738
  neuraminidase__InfluenzaA__AFN17489

SEQ ID NO: 22678 - protein, 469 aa, Artificial Sequence; identical to SEQ ID NO: 16738
  neuraminidase__InfluenzaA__AFN17499

SEQ ID NO: 22679 - protein, 469 aa, Artificial Sequence; identical to SEQ ID NO: 16738
  neuraminidase__InfluenzaA__AFN17509

SEQ ID NO: 22680 - protein, 469 aa, Artificial Sequence; identical to SEQ ID NO: 16738
  neuraminidase__InfluenzaA__AFN17519

SEQ ID NO: 22681 - protein, 469 aa, Artificial Sequence; identical to SEQ ID NO: 16738
  neuraminidase__InfluenzaA__AFN17529

SEQ ID NO: 22682 - protein, 469 aa, Artificial Sequence; identical to SEQ ID NO: 16738
  neuraminidase__InfluenzaA__AFN17539

SEQ ID NO: 22683 - protein, 469 aa, Artificial Sequence; identical to SEQ ID NO: 16738
  neuraminidase__InfluenzaA__AFN17549

SEQ ID NO: 22684 - protein, 469 aa, Artificial Sequence; identical to SEQ ID NO: 16738
  neuraminidase__InfluenzaA__AFN17559

SEQ ID NO: 22685 - protein, 469 aa, Artificial Sequence; identical to SEQ ID NO: 16738
  neuraminidase__InfluenzaA__AFN17569

SEQ ID NO: 22686 - protein, 469 aa, Artificial Sequence; identical to SEQ ID NO: 16738
  neuraminidase__InfluenzaA__AFN17575

SEQ ID NO: 22687 - protein, 469 aa, Artificial Sequence; identical to SEQ ID NO: 16738
  neuraminidase__InfluenzaA__AFN17581

SEQ ID NO: 22688 - protein, 469 aa, Artificial Sequence; identical to SEQ ID NO: 16738
  neuraminidase__InfluenzaA__AFN17587

SEQ ID NO: 22689 - protein, 469 aa, Artificial Sequence; identical to SEQ ID NO: 16738
  neuraminidase__InfluenzaA__AFN17597

SEQ ID NO: 22690 - protein, 469 aa, Artificial Sequence; identical to SEQ ID NO: 22371
  neuraminidase__InfluenzaA__AFN17607

SEQ ID NO: 22691 - protein, 469 aa, Artificial Sequence; identical to SEQ ID NO: 16738
  neuraminidase__InfluenzaA__AFN17617

SEQ ID NO: 22692 - protein, 469 aa, Artificial Sequence; identical to SEQ ID NO: 16738
  neuraminidase__InfluenzaA__AFN17627

SEQ ID NO: 22693 - protein, 469 aa, Artificial Sequence; identical to SEQ ID NO: 16738
  neuraminidase__InfluenzaA__AFN17637

SEQ ID NO: 22694 - protein, 469 aa, Artificial Sequence; identical to SEQ ID NO: 16738
  neuraminidase__InfluenzaA__AFN17647

SEQ ID NO: 22695 - protein, 469 aa, Artificial Sequence; identical to SEQ ID NO: 16738
  neuraminidase__InfluenzaA__AFN17657

SEQ ID NO: 22696 - protein, 469 aa, Artificial Sequence; identical to SEQ ID NO: 16738
  neuraminidase__InfluenzaA__AFN17667

SEQ ID NO: 22697 - protein, 469 aa, Artificial Sequence; identical to SEQ ID NO: 16738
  neuraminidase__InfluenzaA__AFN17677

SEQ ID NO: 22698 - protein, 469 aa, Artificial Sequence; identical to SEQ ID NO: 22371
  neuraminidase__InfluenzaA__AFN17687

SEQ ID NO: 22699 - protein, 469 aa, Artificial Sequence; identical to SEQ ID NO: 16738
  neuraminidase__InfluenzaA__AFN17697

SEQ ID NO: 22700 - protein, 469 aa, Artificial Sequence; identical to SEQ ID NO: 22371
  neuraminidase__InfluenzaA__AFN17707

SEQ ID NO: 22701 - protein, 469 aa, Artificial Sequence; identical to SEQ ID NO: 16738
  neuraminidase__InfluenzaA__AFN17717

SEQ ID NO: 22702 - protein, 469 aa, Artificial Sequence; identical to SEQ ID NO: 22371
  neuraminidase__InfluenzaA__AFN17727

SEQ ID NO: 22703 - protein, 469 aa, Artificial Sequence; identical to SEQ ID NO: 16738
  neuraminidase__InfluenzaA__AFN17737

SEQ ID NO: 22704 - protein, 469 aa, Artificial Sequence; identical to SEQ ID NO: 16738
  neuraminidase__InfluenzaA__AFN17743

SEQ ID NO: 22705 - protein, 469 aa, Artificial Sequence; identical to SEQ ID NO: 22371
  neuraminidase__InfluenzaA__AFN17749

SEQ ID NO: 22706 - protein, 469 aa, Artificial Sequence; identical to SEQ ID NO: 16738
  neuraminidase__InfluenzaA__AFN17759

SEQ ID NO: 22707 - protein, 469 aa, Artificial Sequence; identical to SEQ ID NO: 16738
  neuraminidase__InfluenzaA__AFN17769

SEQ ID NO: 22708 - protein, 469 aa, Artificial Sequence; identical to SEQ ID NO: 16738
  neuraminidase__InfluenzaA__AFN17775

SEQ ID NO: 22709 - protein, 469 aa, Artificial Sequence
  neuraminidase__InfluenzaA__AFN17785
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTLMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNTFSIKQDIVGINEWSGYSGSFVQHPELTGLDCIRPCFWVELIRGRPKENTIWTSGSSISFCGVNSDTVGWSWPDGAELPFTIDK

SEQ ID NO: 22710 - protein, 469 aa, Artificial Sequence
  neuraminidase__InfluenzaA__AFN17795
MNPNQKIITIGSVCMTIGMANLILQIGNIISIWISHSIQLGNQNQIETCNQSVITYENNTWVNQTYVNISNTNFAAGQSVVSVKLAGNSSLCPVGGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22711 - protein, 469 aa, Artificial Sequence; identical to SEQ ID NO: 16738
  neuraminidase__InfluenzaA__AFN17805

SEQ ID NO: 22712 - protein, 469 aa, Artificial Sequence
  neuraminidase__InfluenzaA__AFN17815
MNPNQKIITIGSVSMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22713 - protein, 469 aa, Artificial Sequence; identical to SEQ ID NO: 16738
  neuraminidase__InfluenzaA__AFN17825

SEQ ID NO: 22714 - protein, 469 aa, Artificial Sequence; identical to SEQ ID NO: 22371
  neuraminidase__InfluenzaA__AFN17835

SEQ ID NO: 22715 - protein, 469 aa, Artificial Sequence; identical to SEQ ID NO: 16738
  neuraminidase__InfluenzaA__AFN17845

SEQ ID NO: 22716 - protein, 469 aa, Artificial Sequence; identical to SEQ ID NO: 16738
  neuraminidase__InfluenzaA__AFN17855

SEQ ID NO: 22717 - protein, 469 aa, Artificial Sequence; identical to SEQ ID NO: 18552
  neuraminidase__InfluenzaA__AFN17865

SEQ ID NO: 22718 - protein, 469 aa, Artificial Sequence; identical to SEQ ID NO: 22371
  neuraminidase__InfluenzaA__AFN17875

SEQ ID NO: 22719 - protein, 469 aa, Artificial Sequence; identical to SEQ ID NO: 22371
  neuraminidase__InfluenzaA__AFN17885

SEQ ID NO: 22720 - protein, 469 aa, Artificial Sequence; identical to SEQ ID NO: 16738
  neuraminidase__InfluenzaA__AFN17895

SEQ ID NO: 22721 - protein, 469 aa, Artificial Sequence; identical to SEQ ID NO: 22371
  neuraminidase__InfluenzaA__AFN17905

SEQ ID NO: 22722 - protein, 469 aa, Artificial Sequence; identical to SEQ ID NO: 16738
  neuraminidase__InfluenzaA__AFN17911

SEQ ID NO: 22723 - protein, 469 aa, Artificial Sequence; identical to SEQ ID NO: 22371
  neuraminidase__InfluenzaA__AFN17921

SEQ ID NO: 22724 - protein, 469 aa, Artificial Sequence
  neuraminidase__InfluenzaA__AFN17931
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSRGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22725 - protein, 469 aa, Artificial Sequence; identical to SEQ ID NO: 16738
  neuraminidase__InfluenzaA__AFN17941

SEQ ID NO: 22726 - protein, 469 aa, Artificial Sequence; identical to SEQ ID NO: 16738
  neuraminidase__InfluenzaA__AFN17951

SEQ ID NO: 22727 - protein, 469 aa, Artificial Sequence
  neuraminidase__InfluenzaA__AFN17961
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVNSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22728 - protein, 469 aa, Artificial Sequence; identical to SEQ ID NO: 16738
  neuraminidase__InfluenzaA__AFN17971

SEQ ID NO: 22729 - protein, 469 aa, Artificial Sequence; identical to SEQ ID NO: 16738
  neuraminidase__InfluenzaA__AFN17981

SEQ ID NO: 22730 - protein, 469 aa, Artificial Sequence; identical to SEQ ID NO: 16738
  neuraminidase__InfluenzaA__AFN17991

SEQ ID NO: 22731 - protein, 469 aa, Artificial Sequence
  neuraminidase__InfluenzaA__AFN18001
MNPNQKIITISSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTLMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22732 - protein, 469 aa, Artificial Sequence; identical to SEQ ID NO: 16738
  neuraminidase__InfluenzaA__AFN18011

SEQ ID NO: 22733 - protein, 469 aa, Artificial Sequence; identical to SEQ ID NO: 16738
  neuraminidase__InfluenzaA__AFN18021

SEQ ID NO: 22734 - protein, 469 aa, Artificial Sequence
  neuraminidase__InfluenzaA__AFN18031
MNPNQKIITIGSICMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTLMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22735 - protein, 469 aa, Artificial Sequence; identical to SEQ ID NO: 16738
  neuraminidase__InfluenzaA__AFN18041

SEQ ID NO: 22736 - protein, 469 aa, Artificial Sequence; identical to SEQ ID NO: 22371
  neuraminidase__InfluenzaA__AFN18051

SEQ ID NO: 22737 - protein, 469 aa, Artificial Sequence; identical to SEQ ID NO: 22371
  neuraminidase__InfluenzaA__AFN18061

SEQ ID NO: 22738 - protein, 469 aa, Artificial Sequence; identical to SEQ ID NO: 16738
  neuraminidase__InfluenzaA__AFN18070

SEQ ID NO: 22739 - protein, 469 aa, Artificial Sequence; identical to SEQ ID NO: 16738
  neuraminidase__InfluenzaA__AFN18080

SEQ ID NO: 22740 - protein, 469 aa, Artificial Sequence; identical to SEQ ID NO: 16738
  neuraminidase__InfluenzaA__AFN18090

SEQ ID NO: 22741 - protein, 469 aa, Artificial Sequence; identical to SEQ ID NO: 16738
  neuraminidase__InfluenzaA__AFN18100

SEQ ID NO: 22742 - protein, 469 aa, Artificial Sequence; identical to SEQ ID NO: 16738
  neuraminidase__InfluenzaA__AFN18106

SEQ ID NO: 22743 - protein, 469 aa, Artificial Sequence
  neuraminidase__InfluenzaA__AFN18108
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVLSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22744 - protein, 469 aa, Artificial Sequence
  neuraminidase__InfluenzaA__AFN18118
MNPNQKIITIGSVCMTIGMANLILQIGNMISIWISHSIQLGNQNQIETCNQSVITYENNTWVNQTYVKISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTLMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22745 - protein, 469 aa, Artificial Sequence; identical to SEQ ID NO: 16738
  neuraminidase__InfluenzaA__AFN18120

SEQ ID NO: 22746 - protein, 469 aa, Artificial Sequence; identical to SEQ ID NO: 16738
  neuraminidase__InfluenzaA__AFN18122

SEQ ID NO: 22747 - protein, 469 aa, Artificial Sequence; identical to SEQ ID NO: 22371
  neuraminidase__InfluenzaA__AFN18128

SEQ ID NO: 22748 - protein, 469 aa, Artificial Sequence; identical to SEQ ID NO: 22371
  neuraminidase__InfluenzaA__AFN18134

SEQ ID NO: 22749 - protein, 469 aa, Artificial Sequence; identical to SEQ ID NO: 16738
  neuraminidase__InfluenzaA__AFN18136

SEQ ID NO: 22750 - protein, 469 aa, Artificial Sequence; identical to SEQ ID NO: 16738
  neuraminidase__InfluenzaA__AFN18138

SEQ ID NO: 22751 - protein, 469 aa, Artificial Sequence
  neuraminidase__InfluenzaA__AFN18140
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGIWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22752 - protein, 469 aa, Artificial Sequence; identical to SEQ ID NO: 16738
  neuraminidase__InfluenzaA__AFN18144

SEQ ID NO: 22753 - protein, 469 aa, Artificial Sequence; identical to SEQ ID NO: 16738
  neuraminidase__InfluenzaA__AFN18150

SEQ ID NO: 22754 - protein, 469 aa, Artificial Sequence; identical to SEQ ID NO: 16738
  neuraminidase__InfluenzaA__AFN18156

SEQ ID NO: 22755 - protein, 469 aa, Artificial Sequence; identical to SEQ ID NO: 16738
  neuraminidase__InfluenzaA__AFN18158

SEQ ID NO: 22756 - protein, 469 aa, Artificial Sequence; identical to SEQ ID NO: 18552
  neuraminidase__InfluenzaA__AFN18160

SEQ ID NO: 22757 - protein, 469 aa, Artificial Sequence
  neuraminidase__InfluenzaA__AFN18166
MNPNQKIITIGSVCMTIGMANLILQIGNIISIWISHSIQLGNQNQIETCNQSVITYENKTWVNQTYVNISNANFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSKFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22758 - protein, 469 aa, Artificial Sequence; identical to SEQ ID NO: 16738
  neuraminidase__InfluenzaA__AFN18172

SEQ ID NO: 22759 - protein, 469 aa, Artificial Sequence; identical to SEQ ID NO: 17756
  neuraminidase__InfluenzaA__AFN18178

SEQ ID NO: 22760 - protein, 469 aa, Artificial Sequence
  neuraminidase__InfluenzaA__AFN18184
MNPNQKIITIGSVCMTIGMANLILQIGNIISIWISHSIQLGNQNQIETCNQSVITYENNTWVNQTYVNISNTNFAAGQSMVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22761 - protein, 469 aa, Artificial Sequence; identical to SEQ ID NO: 19730
  neuraminidase__InfluenzaA__AFN18190

SEQ ID NO: 22762 - protein, 469 aa, Artificial Sequence; identical to SEQ ID NO: 20751
  neuraminidase__InfluenzaA__AFN18196

SEQ ID NO: 22763 - protein, 469 aa, Artificial Sequence
  neuraminidase__InfluenzaA__AFN18202
MNPNQKIITIGSVCMTIGMANLILQIGNIISIWISHSIQLGNQNQIETCNQSVITYENNTWVNQTYVNISNTNFAAGRSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22764 - protein, 469 aa, Artificial Sequence; identical to SEQ ID NO: 16738
  neuraminidase__InfluenzaA__AFN18208

SEQ ID NO: 22765 - protein, 469 aa, Artificial Sequence
  neuraminidase__InfluenzaA__AFN18210
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRAFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRLKENTIWTSGSSISFCGVNSDTVGWSWPDGAELPFTIDK

SEQ ID NO: 22766 - protein, 469 aa, Artificial Sequence; identical to SEQ ID NO: 17321
  neuraminidase__InfluenzaA__AFN18216

SEQ ID NO: 22767 - protein, 469 aa, Artificial Sequence; identical to SEQ ID NO: 19067
  neuraminidase__InfluenzaA__AFN18226

SEQ ID NO: 22768 - protein, 469 aa, Artificial Sequence; identical to SEQ ID NO: 16738
  neuraminidase__InfluenzaA__AFN18232

SEQ ID NO: 22769 - protein, 469 aa, Artificial Sequence; identical to SEQ ID NO: 16738
  neuraminidase__InfluenzaA__AFN18234

SEQ ID NO: 22770 - protein, 469 aa, Artificial Sequence; identical to SEQ ID NO: 16738
  neuraminidase__InfluenzaA__AFN18244

SEQ ID NO: 22771 - protein, 469 aa, Artificial Sequence; identical to SEQ ID NO: 16738
  neuraminidase__InfluenzaA__AFN18246

SEQ ID NO: 22772 - protein, 469 aa, Artificial Sequence; identical to SEQ ID NO: 19067
  neuraminidase__InfluenzaA__AFN18256

SEQ ID NO: 22773 - protein, 469 aa, Artificial Sequence; identical to SEQ ID NO: 16738
  neuraminidase__InfluenzaA__AFN18262

SEQ ID NO: 22774 - protein, 469 aa, Artificial Sequence; identical to SEQ ID NO: 16738
  neuraminidase__InfluenzaA__AFN18268

SEQ ID NO: 22775 - protein, 469 aa, Artificial Sequence; identical to SEQ ID NO: 16738
  neuraminidase__InfluenzaA__AFN18270

SEQ ID NO: 22776 - protein, 469 aa, Artificial Sequence; identical to SEQ ID NO: 19727
  neuraminidase__InfluenzaA__AFN18272

SEQ ID NO: 22777 - protein, 469 aa, Artificial Sequence; identical to SEQ ID NO: 16738
  neuraminidase__InfluenzaA__AFN18274

SEQ ID NO: 22778 - protein, 469 aa, Artificial Sequence; identical to SEQ ID NO: 16738
  neuraminidase__InfluenzaA__AFN18282

SEQ ID NO: 22779 - protein, 469 aa, Artificial Sequence; identical to SEQ ID NO: 16738
  neuraminidase__InfluenzaA__AFN18304

SEQ ID NO: 22780 - protein, 469 aa, Artificial Sequence
  neuraminidase__InfluenzaA__AFN18306
MNPNQKIITIGSVCMTIGIANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22781 - protein, 469 aa, Artificial Sequence
  neuraminidase__InfluenzaA__AFN18308
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSKGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22782 - protein, 469 aa, Artificial Sequence
  neuraminidase__InfluenzaA__AFN18314
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKEKTIWTSGSSISFCGVNSDTVGWSWPDGAELPFTIDK

SEQ ID NO: 22783 - protein, 469 aa, Artificial Sequence; identical to SEQ ID NO: 16738
  neuraminidase__InfluenzaA__AFN18320

SEQ ID NO: 22784 - protein, 469 aa, Artificial Sequence
  neuraminidase__InfluenzaA__AFN18326
MNPNQKIITIGSVCMTIGMANLLLQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22785 - protein, 469 aa, Artificial Sequence; identical to SEQ ID NO: 16738
  neuraminidase__InfluenzaA__AFN18336

SEQ ID NO: 22786 - protein, 469 aa, Artificial Sequence; identical to SEQ ID NO: 16738
  neuraminidase__InfluenzaA__AFN18346

SEQ ID NO: 22787 - protein, 469 aa, Artificial Sequence; identical to SEQ ID NO: 22371
  neuraminidase__InfluenzaA__AFN18356

SEQ ID NO: 22788 - protein, 469 aa, Artificial Sequence
  neuraminidase__InfluenzaA__AFN18366
MNPNQKIITIGSVCMTIGMANLILQIGNIISIWISHSIQLGNQNQIETCNQSVITYENNTWVNQTYVNISNTNFAAEQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEVTCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22789 - protein, 469 aa, Artificial Sequence; identical to SEQ ID NO: 22371
  neuraminidase__InfluenzaA__AFN18376

SEQ ID NO: 22790 - protein, 469 aa, Artificial Sequence; identical to SEQ ID NO: 16738
  neuraminidase__InfluenzaA__AFN18382

SEQ ID NO: 22791 - protein, 469 aa, Artificial Sequence; identical to SEQ ID NO: 16738
  neuraminidase__InfluenzaA__AFN18392

SEQ ID NO: 22792 - protein, 469 aa, Artificial Sequence; identical to SEQ ID NO: 16738
  neuraminidase__InfluenzaA__AFN18402

SEQ ID NO: 22793 - protein, 469 aa, Artificial Sequence; identical to SEQ ID NO: 16738
  neuraminidase__InfluenzaA__AFN18412

SEQ ID NO: 22794 - protein, 469 aa, Artificial Sequence; identical to SEQ ID NO: 16738
  neuraminidase__InfluenzaA__AFN18422

SEQ ID NO: 22795 - protein, 469 aa, Artificial Sequence; identical to SEQ ID NO: 16738
  neuraminidase__InfluenzaA__AFN18432

SEQ ID NO: 22796 - protein, 469 aa, Artificial Sequence; identical to SEQ ID NO: 16738
  neuraminidase__InfluenzaA__AFN18442

SEQ ID NO: 22797 - protein, 469 aa, Artificial Sequence; identical to SEQ ID NO: 16738
  neuraminidase__InfluenzaA__AFN18452

SEQ ID NO: 22798 - protein, 469 aa, Artificial Sequence; identical to SEQ ID NO: 16738
  neuraminidase__InfluenzaA__AFN18462

SEQ ID NO: 22799 - protein, 469 aa, Artificial Sequence
  neuraminidase__InfluenzaA__AFN18472
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGAKGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22800 - protein, 469 aa, Artificial Sequence; identical to SEQ ID NO: 16738
  neuraminidase__InfluenzaA__AFN18482

SEQ ID NO: 22801 - protein, 469 aa, Artificial Sequence; identical to SEQ ID NO: 16738
  neuraminidase__InfluenzaA__AFN18492

SEQ ID NO: 22802 - protein, 469 aa, Artificial Sequence
  neuraminidase__InfluenzaA__AFN18514
MNPNQKIITIGSVCMTIGMANLILQIGNIISIWISHSIQLGNQNQIETCNQSVITYENNTWVNQTYVNISNTNFAAGQSVVSVKLVGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22803 - protein, 469 aa, Artificial Sequence
  neuraminidase__InfluenzaA__AFN18520
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGVITDTIKSWRNNILRTQESECACVNGSCFTLMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22804 - protein, 469 aa, Artificial Sequence; identical to SEQ ID NO: 16738
  neuraminidase__InfluenzaA__AFN18522

SEQ ID NO: 22805 - protein, 469 aa, Artificial Sequence; identical to SEQ ID NO: 16738
  neuraminidase__InfluenzaA__AFN18524

SEQ ID NO: 22806 - protein, 469 aa, Artificial Sequence; identical to SEQ ID NO: 22371
  neuraminidase__InfluenzaA__AFN18530

SEQ ID NO: 22807 - protein, 469 aa, Artificial Sequence; identical to SEQ ID NO: 16738
  neuraminidase__InfluenzaA__AFN18532

SEQ ID NO: 22808 - protein, 469 aa, Artificial Sequence; identical to SEQ ID NO: 16738
  neuraminidase__InfluenzaA__AFN18538

SEQ ID NO: 22809 - protein, 469 aa, Artificial Sequence; identical to SEQ ID NO: 16738
  neuraminidase__InfluenzaA__AFN18544

SEQ ID NO: 22810 - protein, 469 aa, Artificial Sequence; identical to SEQ ID NO: 16738
  neuraminidase__InfluenzaA__AFN18546

SEQ ID NO: 22811 - protein, 469 aa, Artificial Sequence; identical to SEQ ID NO: 16738
  neuraminidase__InfluenzaA__AFN18552

SEQ ID NO: 22812 - protein, 469 aa, Artificial Sequence; identical to SEQ ID NO: 16738
  neuraminidase__InfluenzaA__AFN18558

SEQ ID NO: 22813 - protein, 469 aa, Artificial Sequence; identical to SEQ ID NO: 16738
  neuraminidase__InfluenzaA__AFN18560

SEQ ID NO: 22814 - protein, 469 aa, Artificial Sequence; identical to SEQ ID NO: 16738
  neuraminidase__InfluenzaA__AFN18562

SEQ ID NO: 22815 - protein, 469 aa, Artificial Sequence; identical to SEQ ID NO: 16738
  neuraminidase__InfluenzaA__AFN18564

SEQ ID NO: 22816 - protein, 469 aa, Artificial Sequence; identical to SEQ ID NO: 16738
  neuraminidase__InfluenzaA__AFN18566

SEQ ID NO: 22817 - protein, 469 aa, Artificial Sequence; identical to SEQ ID NO: 16738
  neuraminidase__InfluenzaA__AFN18572

SEQ ID NO: 22818 - protein, 469 aa, Artificial Sequence; identical to SEQ ID NO: 16738
  neuraminidase__InfluenzaA__AFN18582

SEQ ID NO: 22819 - protein, 469 aa, Artificial Sequence; identical to SEQ ID NO: 16738
  neuraminidase__InfluenzaA__AFN18592

SEQ ID NO: 22820 - protein, 469 aa, Artificial Sequence; identical to SEQ ID NO: 22371
  neuraminidase__InfluenzaA__AFN18602

SEQ ID NO: 22821 - protein, 469 aa, Artificial Sequence
  neuraminidase__InfluenzaA__AFN18612
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIIKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22822 - protein, 469 aa, Artificial Sequence; identical to SEQ ID NO: 16738
  neuraminidase__InfluenzaA__AFN18618

SEQ ID NO: 22823 - protein, 469 aa, Artificial Sequence; identical to SEQ ID NO: 17564
  neuraminidase__InfluenzaA__AFN18624

SEQ ID NO: 22824 - protein, 469 aa, Artificial Sequence
  neuraminidase__InfluenzaA__AFN18630
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLGCIRPCFWVELIRGRPKENTIWTSGSSISFCGVNSDTVGWSWPDGAELPFTIDK

SEQ ID NO: 22825 - protein, 469 aa, Artificial Sequence
  neuraminidase__InfluenzaA__AFN18636
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRSKENTIWTSGSSISFCGVNSDTVGWSWPDGAELPFTIDK

SEQ ID NO: 22826 - protein, 469 aa, Artificial Sequence; identical to SEQ ID NO: 16738
  neuraminidase__InfluenzaA__AFN18646

SEQ ID NO: 22827 - protein, 469 aa, Artificial Sequence; identical to SEQ ID NO: 16738
  neuraminidase__InfluenzaA__AFN18656

SEQ ID NO: 22828 - protein, 469 aa, Artificial Sequence
  neuraminidase__InfluenzaA__AFN18666
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFIIDK

SEQ ID NO: 22829 - protein, 469 aa, Artificial Sequence
  neuraminidase__InfluenzaA__AFN18676
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTETDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22830 - protein, 469 aa, Artificial Sequence
  neuraminidase__InfluenzaA__AFN18686
MNPNQKIITIGSVCMTIGMANLILQIGNIISIWISHSIQLGNQNQIETCNQSVITYENNTWVNQTYVNISSTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTLMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22831 - protein, 469 aa, Artificial Sequence; identical to SEQ ID NO: 16738
  neuraminidase__InfluenzaA__AFN18696

SEQ ID NO: 22832 - protein, 469 aa, Artificial Sequence; identical to SEQ ID NO: 19325
  neuraminidase__InfluenzaA__AFN18706

SEQ ID NO: 22833 - protein, 469 aa, Artificial Sequence; identical to SEQ ID NO: 16738
  neuraminidase__InfluenzaA__AFN18716

SEQ ID NO: 22834 - protein, 469 aa, Artificial Sequence; identical to SEQ ID NO: 16738
  neuraminidase__InfluenzaA__AFN18727

SEQ ID NO: 22835 - protein, 469 aa, Artificial Sequence
  neuraminidase__InfluenzaA__AFN18737
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMVWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22836 - protein, 469 aa, Artificial Sequence; identical to SEQ ID NO: 16738
  neuraminidase__InfluenzaA__AFN18743

SEQ ID NO: 22837 - protein, 469 aa, Artificial Sequence; identical to SEQ ID NO: 16738
  neuraminidase__InfluenzaA__AFN18749

SEQ ID NO: 22838 - protein, 469 aa, Artificial Sequence; identical to SEQ ID NO: 16738
  neuraminidase__InfluenzaA__AFN18759

SEQ ID NO: 22839 - protein, 469 aa, Artificial Sequence
  neuraminidase__InfluenzaA__AFN18769
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTLMTDGPSDGQASYKIFRIEKGKIVKSVEMNAPNYHYEECSCYPDSNEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22840 - protein, 469 aa, Artificial Sequence; identical to SEQ ID NO: 18640
  neuraminidase__InfluenzaA__AFN18775

SEQ ID NO: 22841 - protein, 469 aa, Artificial Sequence; identical to SEQ ID NO: 16738
  neuraminidase__InfluenzaA__AFN18777

SEQ ID NO: 22842 - protein, 469 aa, Artificial Sequence; identical to SEQ ID NO: 16738
  neuraminidase__InfluenzaA__AFN18779

SEQ ID NO: 22843 - protein, 469 aa, Artificial Sequence
  neuraminidase__InfluenzaA__AFN18785
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIRQDIVGINEWSGYSGSFVQHPELTGLDCIRPCFWVELIRGRPKENTIWTSGSSISFCGVNSDTVGWSWPDGAELPFTIDK

SEQ ID NO: 22844 - protein, 469 aa, Artificial Sequence
  neuraminidase__InfluenzaA__AFN18791
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPESSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22845 - protein, 469 aa, Artificial Sequence; identical to SEQ ID NO: 16738
  neuraminidase__InfluenzaA__AFN18801

SEQ ID NO: 22846 - protein, 469 aa, Artificial Sequence; identical to SEQ ID NO: 19157
  neuraminidase__InfluenzaA__AFN18811

SEQ ID NO: 22847 - protein, 469 aa, Artificial Sequence; identical to SEQ ID NO: 16738
  neuraminidase__InfluenzaA__AFN18817

SEQ ID NO: 22848 - protein, 469 aa, Artificial Sequence; identical to SEQ ID NO: 16738
  neuraminidase__InfluenzaA__AFN18819

SEQ ID NO: 22849 - protein, 469 aa, Artificial Sequence; identical to SEQ ID NO: 19730
  neuraminidase__InfluenzaA__AFN18821

SEQ ID NO: 22850 - protein, 469 aa, Artificial Sequence; identical to SEQ ID NO: 16738
  neuraminidase__InfluenzaA__AFN18823

SEQ ID NO: 22851 - protein, 469 aa, Artificial Sequence; identical to SEQ ID NO: 16738
  neuraminidase__InfluenzaA__AFN18825

SEQ ID NO: 22852 - protein, 469 aa, Artificial Sequence; identical to SEQ ID NO: 16738
  neuraminidase__InfluenzaA__AFN18827

SEQ ID NO: 22853 - protein, 469 aa, Artificial Sequence; identical to SEQ ID NO: 16738
  neuraminidase__InfluenzaA__AFN18829

SEQ ID NO: 22854 - protein, 469 aa, Artificial Sequence; identical to SEQ ID NO: 16738
  neuraminidase__InfluenzaA__AFN18831

SEQ ID NO: 22855 - protein, 469 aa, Artificial Sequence; identical to SEQ ID NO: 17875
  neuraminidase__InfluenzaA__AFN18833

SEQ ID NO: 22856 - protein, 469 aa, Artificial Sequence; identical to SEQ ID NO: 17913
  neuraminidase__InfluenzaA__AFN18835

SEQ ID NO: 22857 - protein, 469 aa, Artificial Sequence; identical to SEQ ID NO: 16738
  neuraminidase__InfluenzaA__AFN18841

SEQ ID NO: 22858 - protein, 469 aa, Artificial Sequence
  neuraminidase__InfluenzaA__AFN18851
MNPNQKIITIGSVCMTIGMANLILQIGNMISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22859 - protein, 469 aa, Artificial Sequence; identical to SEQ ID NO: 16738
  neuraminidase__InfluenzaA__AFN18857

SEQ ID NO: 22860 - protein, 469 aa, Artificial Sequence
  neuraminidase__InfluenzaA__AFN18859
MNPNQKIITIGSVCMTIGLANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22861 - protein, 469 aa, Artificial Sequence
  neuraminidase__InfluenzaA__AFN18861
MNPNQKIITIGSVCMTIGMANLILQIGNIISIWISHSIQLGNQNQIETCNQSVITYENNTWVNQTYVNISNTNFAAGQSVVSVKLAGNSSLCSVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22862 - protein, 469 aa, Artificial Sequence; identical to SEQ ID NO: 16738
  neuraminidase__InfluenzaA__AFN18867

SEQ ID NO: 22863 - protein, 469 aa, Artificial Sequence; identical to SEQ ID NO: 18552
  neuraminidase__InfluenzaA__AFN18877

SEQ ID NO: 22864 - protein, 469 aa, Artificial Sequence; identical to SEQ ID NO: 16738
  neuraminidase__InfluenzaA__AFN18887

SEQ ID NO: 22865 - protein, 469 aa, Artificial Sequence; identical to SEQ ID NO: 17756
  neuraminidase__InfluenzaA__AFN18893

SEQ ID NO: 22866 - protein, 469 aa, Artificial Sequence
  neuraminidase__InfluenzaA__AFN18895
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIKGRPKENTIWTSGSSISFCGVNSDTVGWSWPDGAELPFTIDK

SEQ ID NO: 22867 - protein, 469 aa, Artificial Sequence; identical to SEQ ID NO: 18640
  neuraminidase__InfluenzaA__AFN18905

SEQ ID NO: 22868 - protein, 469 aa, Artificial Sequence; identical to SEQ ID NO: 18552
  neuraminidase__InfluenzaA__AFN18913

SEQ ID NO: 22869 - protein, 469 aa, Artificial Sequence
  neuraminidase__InfluenzaA__AFN18919
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGENGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22870 - protein, 469 aa, Artificial Sequence
  neuraminidase__InfluenzaA__AFN18929
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTLMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWSDGAELPFTIDK

SEQ ID NO: 22871 - protein, 469 aa, Artificial Sequence; identical to SEQ ID NO: 16738
  neuraminidase__InfluenzaA__AFN18939

SEQ ID NO: 22872 - protein, 469 aa, Artificial Sequence; identical to SEQ ID NO: 16738
  neuraminidase__InfluenzaA__AFN18953

SEQ ID NO: 22873 - protein, 469 aa, Artificial Sequence; identical to SEQ ID NO: 16738
  neuraminidase__InfluenzaA__AFN18959

SEQ ID NO: 22874 - protein, 469 aa, Artificial Sequence; identical to SEQ ID NO: 16738
  neuraminidase__InfluenzaA__AFN18965

SEQ ID NO: 22875 - protein, 469 aa, Artificial Sequence; identical to SEQ ID NO: 20808
  neuraminidase__InfluenzaA__AFN18975

SEQ ID NO: 22876 - protein, 469 aa, Artificial Sequence; identical to SEQ ID NO: 16738
  neuraminidase__InfluenzaA__AFN18981

SEQ ID NO: 22877 - protein, 469 aa, Artificial Sequence
  neuraminidase__InfluenzaA__AFN18983
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNASNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSIISFCGVNSDTVGWSWPDGAELPFTIDK

SEQ ID NO: 22878 - protein, 469 aa, Artificial Sequence; identical to SEQ ID NO: 16738
  neuraminidase__InfluenzaA__AFN18985

SEQ ID NO: 22879 - protein, 469 aa, Artificial Sequence
  neuraminidase__InfluenzaA__AFN18987
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPIDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22880 - protein, 469 aa, Artificial Sequence; identical to SEQ ID NO: 16738
  neuraminidase__InfluenzaA__AFN18989

SEQ ID NO: 22881 - protein, 469 aa, Artificial Sequence; identical to SEQ ID NO: 16738
  neuraminidase__InfluenzaA__AFN18995

SEQ ID NO: 22882 - protein, 469 aa, Artificial Sequence; identical to SEQ ID NO: 22860
  neuraminidase__InfluenzaA__AFN19001

SEQ ID NO: 22883 - protein, 469 aa, Artificial Sequence; identical to SEQ ID NO: 16738
  neuraminidase__InfluenzaA__AFN19007

SEQ ID NO: 22884 - protein, 469 aa, Artificial Sequence; identical to SEQ ID NO: 16738
  neuraminidase__InfluenzaA__AFN19024

SEQ ID NO: 22885 - protein, 469 aa, Artificial Sequence
  neuraminidase__InfluenzaA__AFN19025
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNKILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22886 - protein, 469 aa, Artificial Sequence; identical to SEQ ID NO: 16738
  neuraminidase__InfluenzaA__AFN19027

SEQ ID NO: 22887 - protein, 469 aa, Artificial Sequence; identical to SEQ ID NO: 16738
  neuraminidase__InfluenzaA__AFN19032

SEQ ID NO: 22888 - protein, 469 aa, Artificial Sequence; identical to SEQ ID NO: 16738
  neuraminidase__InfluenzaA__AFN19038

SEQ ID NO: 22889 - protein, 469 aa, Artificial Sequence; identical to SEQ ID NO: 22371
  neuraminidase__InfluenzaA__AFN19049

SEQ ID NO: 22890 - protein, 469 aa, Artificial Sequence; identical to SEQ ID NO: 16738
  neuraminidase__InfluenzaA__AFN19055

SEQ ID NO: 22891 - protein, 469 aa, Artificial Sequence; identical to SEQ ID NO: 16738
  neuraminidase__InfluenzaA__AFN19065

SEQ ID NO: 22892 - protein, 469 aa, Artificial Sequence; identical to SEQ ID NO: 16738
  neuraminidase__InfluenzaA__AFN19071

SEQ ID NO: 22893 - protein, 469 aa, Artificial Sequence; identical to SEQ ID NO: 16738
  neuraminidase__InfluenzaA__AFN19077

SEQ ID NO: 22894 - protein, 469 aa, Artificial Sequence; identical to SEQ ID NO: 16738
  neuraminidase__InfluenzaA__AFN19083

SEQ ID NO: 22895 - protein, 469 aa, Artificial Sequence; identical to SEQ ID NO: 16738
  neuraminidase__InfluenzaA__AFN19089

SEQ ID NO: 22896 - protein, 469 aa, Artificial Sequence; identical to SEQ ID NO: 16738
  neuraminidase__InfluenzaA__AFN19099

SEQ ID NO: 22897 - protein, 469 aa, Artificial Sequence; identical to SEQ ID NO: 16738
  neuraminidase__InfluenzaA__AFN19105

SEQ ID NO: 22898 - protein, 469 aa, Artificial Sequence; identical to SEQ ID NO: 16738
  neuraminidase__InfluenzaA__AFN19114

SEQ ID NO: 22899 - protein, 469 aa, Artificial Sequence; identical to SEQ ID NO: 16738
  neuraminidase__InfluenzaA__AFN19126

SEQ ID NO: 22900 - protein, 469 aa, Artificial Sequence; identical to SEQ ID NO: 16738
  neuraminidase__InfluenzaA__AFN19136

SEQ ID NO: 22901 - protein, 469 aa, Artificial Sequence; identical to SEQ ID NO: 16738
  neuraminidase__InfluenzaA__AFN19146

SEQ ID NO: 22902 - protein, 469 aa, Artificial Sequence; identical to SEQ ID NO: 16738
  neuraminidase__InfluenzaA__AFN19156

SEQ ID NO: 22903 - protein, 469 aa, Artificial Sequence; identical to SEQ ID NO: 16738
  neuraminidase__InfluenzaA__AFN19166

SEQ ID NO: 22904 - protein, 469 aa, Artificial Sequence; identical to SEQ ID NO: 16738
  neuraminidase__InfluenzaA__AFN19186

SEQ ID NO: 22905 - protein, 469 aa, Artificial Sequence; identical to SEQ ID NO: 22371
  neuraminidase__InfluenzaA__AFN19196

SEQ ID NO: 22906 - protein, 469 aa, Artificial Sequence; identical to SEQ ID NO: 16738
  neuraminidase__InfluenzaA__AFN19205

SEQ ID NO: 22907 - protein, 469 aa, Artificial Sequence; identical to SEQ ID NO: 16738
  neuraminidase__InfluenzaA__AFN19215

SEQ ID NO: 22908 - protein, 469 aa, Artificial Sequence; identical to SEQ ID NO: 16738
  neuraminidase__InfluenzaA__AFN19225

SEQ ID NO: 22909 - protein, 469 aa, Artificial Sequence; identical to SEQ ID NO: 16738
  neuraminidase__InfluenzaA__AFN19235

SEQ ID NO: 22910 - protein, 469 aa, Artificial Sequence; identical to SEQ ID NO: 16738
  neuraminidase__InfluenzaA__AFN19245

SEQ ID NO: 22911 - protein, 469 aa, Artificial Sequence; identical to SEQ ID NO: 16738
  neuraminidase__InfluenzaA__AFN19251

SEQ ID NO: 22912 - protein, 469 aa, Artificial Sequence; identical to SEQ ID NO: 16738
  neuraminidase__InfluenzaA__AFN19261

SEQ ID NO: 22913 - protein, 469 aa, Artificial Sequence; identical to SEQ ID NO: 22371
  neuraminidase__InfluenzaA__AFN19271

SEQ ID NO: 22914 - protein, 469 aa, Artificial Sequence; identical to SEQ ID NO: 18469
  neuraminidase__InfluenzaA__AFN19281

SEQ ID NO: 22915 - protein, 469 aa, Artificial Sequence
  neuraminidase__InfluenzaA__AFN19287
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLSDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 22916 - protein, 469 aa, Artificial Sequence; identical to SEQ ID NO: 16738
  neuraminidase__InfluenzaA__AFN19297

SEQ ID NO: 22917 - protein, 469 aa, Artificial Sequence; identical to SEQ ID NO: 16738
  neuraminidase__InfluenzaA__AFN19307

SEQ ID NO: 22918 - protein, 469 aa, Artificial Sequence; identical to SEQ ID NO: 16738
  neuraminidase__InfluenzaA__AFN19317

SEQ ID NO: 22919 - protein, 469 aa, Artificial Sequence; identical to SEQ ID NO: 22371
  neuraminidase__InfluenzaA__AFN19327

SEQ ID NO: 22920 - protein, 469 aa, Artificial Sequence; identical to SEQ ID NO: 16738
  neuraminidase__InfluenzaA__AFN19346

SEQ ID NO: 22921 - protein, 469 aa, Artificial Sequence
  neuraminidase__InfluenzaA__AFN19352
MNPNQKIITIGSVSLTISTICFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 22922 - protein, 469 aa, Artificial Sequence
  neuraminidase__InfluenzaA__AFN19354
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22923 - protein, 469 aa, Artificial Sequence; identical to SEQ ID NO: 22922
  neuraminidase__InfluenzaA__AFN19356

SEQ ID NO: 22924 - protein, 469 aa, Artificial Sequence; identical to SEQ ID NO: 22922
  neuraminidase__InfluenzaA__AFN19358

SEQ ID NO: 22925 - protein, 469 aa, Artificial Sequence; identical to SEQ ID NO: 22922
  neuraminidase__InfluenzaA__AFN19360

SEQ ID NO: 22926 - protein, 469 aa, Artificial Sequence
  neuraminidase__InfluenzaA__AFN19362
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKRCINRCFYVELIRGRKEETEVLWTSNSIVVFCGTSGTYGTGSWPDGADLNLMPI

SEQ ID NO: 22927 - protein, 469 aa, Artificial Sequence; identical to SEQ ID NO: 22922
  neuraminidase__InfluenzaA__AFN19364

SEQ ID NO: 22928 - protein, 469 aa, Artificial Sequence; identical to SEQ ID NO: 19518
  neuraminidase__InfluenzaA__AFN19366

SEQ ID NO: 22929 - protein, 469 aa, Artificial Sequence; identical to SEQ ID NO: 22922
  neuraminidase__InfluenzaA__AFN19370

SEQ ID NO: 22930 - protein, 469 aa, Artificial Sequence
  neuraminidase__InfluenzaA__AFN19374
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIKEGKIVHTSTLSGSAQHVEECSCYPRYPGVRCVCRDNWKGSNRPIVDINIKDHSIVSSYVCSGLVGDTPRKTDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22931 - protein, 469 aa, Artificial Sequence; identical to SEQ ID NO: 22922
  neuraminidase__InfluenzaA__AFN19376

SEQ ID NO: 22932 - protein, 469 aa, Artificial Sequence; identical to SEQ ID NO: 22922
  neuraminidase__InfluenzaA__AFN19378

SEQ ID NO: 22933 - protein, 469 aa, Artificial Sequence
  neuraminidase__InfluenzaA__AFN19380
MNPNQKIITIGSVSLTISTICFFMQIAILITTVTLHFKQYEFNSPPNNQVMLCEPTIIERNITEIVYLTNTTIEKEICPKPSEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22934 - protein, 469 aa, Artificial Sequence; identical to SEQ ID NO: 22930
  neuraminidase__InfluenzaA__AFN19382

SEQ ID NO: 22935 - protein, 469 aa, Artificial Sequence; identical to SEQ ID NO: 22922
  neuraminidase__InfluenzaA__AFN19384

SEQ ID NO: 22936 - protein, 469 aa, Artificial Sequence
  neuraminidase__InfluenzaA__AFN19386
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQIIVDRGDRSGYSGIFSVEGKSCINRCFYVELIRGRKEETEVLWTSNSIVVFCGTSGTYGTGSWPDGADLNLMPI

SEQ ID NO: 22937 - protein, 469 aa, Artificial Sequence; identical to SEQ ID NO: 22922
  neuraminidase__InfluenzaA__AFN19388

SEQ ID NO: 22938 - protein, 469 aa, Artificial Sequence; identical to SEQ ID NO: 22922
  neuraminidase__InfluenzaA__AFN19390

SEQ ID NO: 22939 - protein, 469 aa, Artificial Sequence
  neuraminidase__InfluenzaA__AFN19392
MNPNQKIITIGSVSLTISTICFFMQIAVLITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22940 - protein, 469 aa, Artificial Sequence; identical to SEQ ID NO: 21787
  neuraminidase__InfluenzaA__AFN19394

SEQ ID NO: 22941 - protein, 469 aa, Artificial Sequence
  neuraminidase__InfluenzaA__AFN19396
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCAVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKNCINRCFYVELIRGRKEETEVLWTSNSIVVFCGTSGTYGTGSWPDGADLNLMPI

SEQ ID NO: 22942 - protein, 469 aa, Artificial Sequence
  neuraminidase__InfluenzaA__AFN19398
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWRGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22943 - protein, 469 aa, Artificial Sequence
  neuraminidase__InfluenzaA__AFN19400
MNPNQKIITIGSVSLTISTICFFMQIAILITTVTLHFKQYEFNSPPNNQVMLCEPTIIERNITEIVYLTNTTIEKEICPKPSEYRNWSKPQCDITGFAPFSKDNSIRLSDGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22944 - protein, 469 aa, Artificial Sequence; identical to SEQ ID NO: 22922
  neuraminidase__InfluenzaA__AFN19402

SEQ ID NO: 22945 - protein, 469 aa, Artificial Sequence; identical to SEQ ID NO: 22922
  neuraminidase__InfluenzaA__AFN19404

SEQ ID NO: 22946 - protein, 469 aa, Artificial Sequence; identical to SEQ ID NO: 22922
  neuraminidase__InfluenzaA__AFN19406

SEQ ID NO: 22947 - protein, 469 aa, Artificial Sequence; identical to SEQ ID NO: 22922
  neuraminidase__InfluenzaA__AFN19410

SEQ ID NO: 22948 - protein, 469 aa, Artificial Sequence; identical to SEQ ID NO: 22922
  neuraminidase__InfluenzaA__AFN19412

SEQ ID NO: 22949 - protein, 469 aa, Artificial Sequence; identical to SEQ ID NO: 22922
  neuraminidase__InfluenzaA__AFN19414

SEQ ID NO: 22950 - protein, 469 aa, Artificial Sequence; identical to SEQ ID NO: 22922
  neuraminidase__InfluenzaA__AFN19416

SEQ ID NO: 22951 - protein, 469 aa, Artificial Sequence
  neuraminidase__InfluenzaA__AFN19418
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGRADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22952 - protein, 469 aa, Artificial Sequence
  neuraminidase__InfluenzaA__AFN19420
MNPNQKIITIGSVSLTISTICFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22953 - protein, 469 aa, Artificial Sequence
  neuraminidase__InfluenzaA__AFN19422
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGNDKNATASFIYNGRLVDSVVSWSKEVLRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22954 - protein, 469 aa, Artificial Sequence
  neuraminidase__InfluenzaA__AFN19426
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDENATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22955 - protein, 469 aa, Artificial Sequence; identical to SEQ ID NO: 22922
  neuraminidase__InfluenzaA__AFN19428

SEQ ID NO: 22956 - protein, 469 aa, Artificial Sequence
  neuraminidase__InfluenzaA__AFN19430
MNPNQKIITIGSVSLTISTICFFMQIAILIITVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 22957 - protein, 469 aa, Artificial Sequence
  neuraminidase__InfluenzaA__AFN19432
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPHRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22958 - protein, 469 aa, Artificial Sequence
  neuraminidase__InfluenzaA__AFN19434
MNPNQKIITIGSVSLTISTICFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 22959 - protein, 469 aa, Artificial Sequence; identical to SEQ ID NO: 22146
  neuraminidase__InfluenzaA__AFN19436

SEQ ID NO: 22960 - protein, 469 aa, Artificial Sequence
  neuraminidase__InfluenzaA__AFN19438
MNPNQKIITIGSVSLTISTICFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMSI

SEQ ID NO: 22961 - protein, 469 aa, Artificial Sequence
  neuraminidase__InfluenzaA__AFN19442
MNPNQKIITIGSVSLTISTICFFMQIAILITTVTLHFKQYEFNSPPNNQVMLCEPTIIERNITEIVYLTNTIIEKEICPKPTEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMHI

SEQ ID NO: 22962 - protein, 469 aa, Artificial Sequence; identical to SEQ ID NO: 22146
  neuraminidase__InfluenzaA__AFN19446

SEQ ID NO: 22963 - protein, 469 aa, Artificial Sequence; identical to SEQ ID NO: 22146
  neuraminidase__InfluenzaA__AFN19448

SEQ ID NO: 22964 - protein, 469 aa, Artificial Sequence; identical to SEQ ID NO: 22922
  neuraminidase__InfluenzaA__AFN19458

SEQ ID NO: 22965 - protein, 469 aa, Artificial Sequence
  neuraminidase__InfluenzaA__AFN19460
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSNEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEENEVLWTSNSIVVFCGTSGTYGTGSWPDGADLNLMPI

SEQ ID NO: 22966 - protein, 469 aa, Artificial Sequence; identical to SEQ ID NO: 22146
  neuraminidase__InfluenzaA__AFN19462

SEQ ID NO: 22967 - protein, 469 aa, Artificial Sequence
  neuraminidase__InfluenzaA__AFN19466
MNPNQKIITIGSVSLTISTICFFMQIAILITTVTLHFKQYEFNSPPNNQVMLCEPTIIERNITEIVYLTNTTIEKEICPKPAEYRNWSKPQCDIAGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22968 - protein, 469 aa, Artificial Sequence; identical to SEQ ID NO: 22146
  neuraminidase__InfluenzaA__AFN19468

SEQ ID NO: 22969 - protein, 469 aa, Artificial Sequence
  neuraminidase__InfluenzaA__AFN19470
MNPNQKIITIGSVSLTISTICFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVNKSDRSGYSGIFSVEGKSCINRCFYVELIRGRKEETEVLWTSNSIVVFCGTSGTYGTGSWPDGADLNLMPI

SEQ ID NO: 22970 - protein, 469 aa, Artificial Sequence; identical to SEQ ID NO: 22922
  neuraminidase__InfluenzaA__AFN19472

SEQ ID NO: 22971 - protein, 469 aa, Artificial Sequence
  neuraminidase__InfluenzaA__AFN19476
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPLSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22972 - protein, 469 aa, Artificial Sequence; identical to SEQ ID NO: 22922
  neuraminidase__InfluenzaA__AFN19478

SEQ ID NO: 22973 - protein, 469 aa, Artificial Sequence
  neuraminidase__InfluenzaA__AFN19480
MNPNQKIITIGSVSLTISTICFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNTVGDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 22974 - protein, 469 aa, Artificial Sequence
  neuraminidase__InfluenzaA__AFN19482
MNPNQKIITIGSVSLTISTICFFMQIAILITTVTLHFKQYEFNSPPNNQVMLCEPTIIERNITEIVYLTNTTIEKEICPKPAKYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 22975 - protein, 469 aa, Artificial Sequence; identical to SEQ ID NO: 22146
  neuraminidase__InfluenzaA__AFN19484

SEQ ID NO: 22976 - protein, 469 aa, Artificial Sequence; identical to SEQ ID NO: 22922
  neuraminidase__InfluenzaA__AFN19488

SEQ ID NO: 22977 - protein, 469 aa, Artificial Sequence
  neuraminidase__InfluenzaA__AFN19492
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22978 - protein, 469 aa, Artificial Sequence
  neuraminidase__InfluenzaA__AFN19494
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 22979 - protein, 469 aa, Artificial Sequence; identical to SEQ ID NO: 21787
  neuraminidase__InfluenzaA__AFN19496

SEQ ID NO: 22980 - protein, 469 aa, Artificial Sequence
  neuraminidase__InfluenzaA__AFN19498
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRTEETEVLWTSNSIVVFCGTSGTYGTGSWPDGADLNLMPI

SEQ ID NO: 22981 - protein, 469 aa, Artificial Sequence; identical to SEQ ID NO: 22930
  neuraminidase__InfluenzaA__AFN19500

SEQ ID NO: 22982 - protein, 469 aa, Artificial Sequence; identical to SEQ ID NO: 22922
  neuraminidase__InfluenzaA__AFN19502

SEQ ID NO: 22983 - protein, 469 aa, Artificial Sequence; identical to SEQ ID NO: 19518
  neuraminidase__InfluenzaA__AFN19504

SEQ ID NO: 22984 - protein, 469 aa, Artificial Sequence; identical to SEQ ID NO: 19518
  neuraminidase__InfluenzaA__AFN19506

SEQ ID NO: 22985 - protein, 469 aa, Artificial Sequence; identical to SEQ ID NO: 22930
  neuraminidase__InfluenzaA__AFN19508

SEQ ID NO: 22986 - protein, 469 aa, Artificial Sequence; identical to SEQ ID NO: 22922
  neuraminidase__InfluenzaA__AFN19510

SEQ ID NO: 22987 - protein, 469 aa, Artificial Sequence; identical to SEQ ID NO: 22922
  neuraminidase__InfluenzaA__AFN19512

SEQ ID NO: 22988 - protein, 469 aa, Artificial Sequence; identical to SEQ ID NO: 22922
  neuraminidase__InfluenzaA__AFN19516

SEQ ID NO: 22989 - protein, 469 aa, Artificial Sequence; identical to SEQ ID NO: 22930
  neuraminidase__InfluenzaA__AFN19518

SEQ ID NO: 22990 - protein, 469 aa, Artificial Sequence; identical to SEQ ID NO: 22930
  neuraminidase__InfluenzaA__AFN19520

SEQ ID NO: 22991 - protein, 469 aa, Artificial Sequence; identical to SEQ ID NO: 22922
  neuraminidase__InfluenzaA__AFN19522

SEQ ID NO: 22992 - protein, 469 aa, Artificial Sequence
  neuraminidase__InfluenzaA__AFN19524
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLSLMPI

SEQ ID NO: 22993 - protein, 469 aa, Artificial Sequence
  neuraminidase__InfluenzaA__AFN19526
MNPNQKIITIGSVSLTISTICFFMQIAILITTVTLHFKQCEFNSPPNNQVMLCEPTIIERNITEIVYLTNTTTEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKTDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 22994 - protein, 469 aa, Artificial Sequence
  neuraminidase__InfluenzaA__AFN19528
MNPNQKIITIGSVSLTISTICFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKSDTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 22995 - protein, 469 aa, Artificial Sequence; identical to SEQ ID NO: 22958
  neuraminidase__InfluenzaA__AFN19530

SEQ ID NO: 22996 - protein, 469 aa, Artificial Sequence; identical to SEQ ID NO: 22922
  neuraminidase__InfluenzaA__AFN19532

SEQ ID NO: 22997 - protein, 469 aa, Artificial Sequence; identical to SEQ ID NO: 22958
  neuraminidase__InfluenzaA__AFN19534

SEQ ID NO: 22998 - protein, 469 aa, Artificial Sequence; identical to SEQ ID NO: 22922
  neuraminidase__InfluenzaA__AFN19536

SEQ ID NO: 22999 - protein, 469 aa, Artificial Sequence; identical to SEQ ID NO: 22922
  neuraminidase__InfluenzaA__AFN19538

SEQ ID NO: 23000 - protein, 469 aa, Artificial Sequence; identical to SEQ ID NO: 22922
  neuraminidase__InfluenzaA__AFN19544

SEQ ID NO: 23001 - protein, 469 aa, Artificial Sequence
  neuraminidase__InfluenzaA__AFN19546
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMSELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23002 - protein, 469 aa, Artificial Sequence
  neuraminidase__InfluenzaA__AFN19548
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSFSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23003 - protein, 469 aa, Artificial Sequence
  neuraminidase__InfluenzaA__AFN19550
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGEADTKILFIEEGKIIHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23004 - protein, 469 aa, Artificial Sequence; identical to SEQ ID NO: 22922
  neuraminidase__InfluenzaA__AFN19552

SEQ ID NO: 23005 - protein, 469 aa, Artificial Sequence; identical to SEQ ID NO: 22146
  neuraminidase__InfluenzaA__AFN19554

SEQ ID NO: 23006 - protein, 469 aa, Artificial Sequence; identical to SEQ ID NO: 22146
  neuraminidase__InfluenzaA__AFN19556

SEQ ID NO: 23007 - protein, 469 aa, Artificial Sequence
  neuraminidase__InfluenzaA__AFN19558
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQMNRQVIVDRGDRSGYSGIFSVEGKSCINRCFYVELIRGRKEETEVLWTSNSIVVFCGTSGTYGTGSWPDGADLNLMPI

SEQ ID NO: 23008 - protein, 469 aa, Artificial Sequence
  neuraminidase__InfluenzaA__AFN19560
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEGGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23009 - protein, 469 aa, Artificial Sequence; identical to SEQ ID NO: 22969
  neuraminidase__InfluenzaA__AFN19562

SEQ ID NO: 23010 - protein, 469 aa, Artificial Sequence
  neuraminidase__InfluenzaA__AFN19564
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKTDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23011 - protein, 469 aa, Artificial Sequence
  neuraminidase__InfluenzaA__AFN19566
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSNEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEENEVLWTSNSIVVFCGTSGTYGTGSWPDGADLNLMPI

SEQ ID NO: 23012 - protein, 469 aa, Artificial Sequence
  neuraminidase__InfluenzaA__AFN19568
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQVNRQVIVDRGDRSGYSGIFSVEGKSCINRCFYVELIRGRKEEIEVLWTSNSIVVFCGTSGTYGTGSWPDGADLNLMPI

SEQ ID NO: 23013 - protein, 469 aa, Artificial Sequence
  neuraminidase__InfluenzaA__AFN19570
MNPNQKIITIGSVSLTISTICFFMQIAILITTVTLHFKQYEFNYPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNMHSNNTVRDRTPYRTLLMNELGVPFHLGTKQVCIAWSSSSCHDGKAWLHVCITGDDKNATASFIYNGRLVDSVVSWSNEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEENEVLWTSNSIVVFCGTSGTYGTGSWPDGADLNLMPI

SEQ ID NO: 23014 - protein, 469 aa, Artificial Sequence
  neuraminidase__InfluenzaA__AFN19572
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRISAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23015 - protein, 469 aa, Artificial Sequence
  neuraminidase__InfluenzaA__AFN19574
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPNKCYQFALGQGTTLNNVHSNNTVRDRTPYRTLLMNELGVPFHLGTKQVCIAWSSSSCHDGKAWLHVCITGDDKNATASFIYNGRLVDSVVSWSKKILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDSSSSSHCFDPNDEEGGHGVKGWAFDDGNDVWMGRTISEKSRLGYETFKVIEGWSNPKSKLQINRQVIVDRGDRSGYSGIFSVEGKSCINRCFYVELIRGSKEETEVLWTSNSIVVFCGTSGTYGTGSWPDGADINLMPI

SEQ ID NO: 23016 - protein, 469 aa, Artificial Sequence
  neuraminidase__InfluenzaA__AFN19576
MNPNQKIITIGSVSLTISTICFFMQIAILITTVTLHFKQYEFNSPPNNQMMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23017 - protein, 469 aa, Artificial Sequence; identical to SEQ ID NO: 22922
  neuraminidase__InfluenzaA__AFN19578

SEQ ID NO: 23018 - protein, 469 aa, Artificial Sequence; identical to SEQ ID NO: 22922
  neuraminidase__InfluenzaA__AFN19582

SEQ ID NO: 23019 - protein, 469 aa, Artificial Sequence; identical to SEQ ID NO: 22922
  neuraminidase__InfluenzaA__AFN19584

SEQ ID NO: 23020 - protein, 469 aa, Artificial Sequence; identical to SEQ ID NO: 22922
  neuraminidase__InfluenzaA__AFN19588

SEQ ID NO: 23021 - protein, 469 aa, Artificial Sequence; identical to SEQ ID NO: 22922
  neuraminidase__InfluenzaA__AFN19590

SEQ ID NO: 23022 - protein, 469 aa, Artificial Sequence; identical to SEQ ID NO: 22958
  neuraminidase__InfluenzaA__AFN19592

SEQ ID NO: 23023 - protein, 469 aa, Artificial Sequence; identical to SEQ ID NO: 22922
  neuraminidase__InfluenzaA__AFN19594

SEQ ID NO: 23024 - protein, 469 aa, Artificial Sequence; identical to SEQ ID NO: 22930
  neuraminidase__InfluenzaA__AFN19596

SEQ ID NO: 23025 - protein, 469 aa, Artificial Sequence; identical to SEQ ID NO: 22930
  neuraminidase__InfluenzaA__AFN19600

SEQ ID NO: 23026 - protein, 469 aa, Artificial Sequence
  neuraminidase__InfluenzaA__AFN19602
MNPNQKIITIGSVSLTLSTICFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 23027 - protein, 469 aa, Artificial Sequence; identical to SEQ ID NO: 22922
  neuraminidase__InfluenzaA__AFN19604

SEQ ID NO: 23028 - protein, 469 aa, Artificial Sequence; identical to SEQ ID NO: 22922
  neuraminidase__InfluenzaA__AFN19606

SEQ ID NO: 23029 - protein, 469 aa, Artificial Sequence; identical to SEQ ID NO: 22922
  neuraminidase__InfluenzaA__AFN19608

SEQ ID NO: 23030 - protein, 469 aa, Artificial Sequence; identical to SEQ ID NO: 22922
  neuraminidase__InfluenzaA__AFN19610

SEQ ID NO: 23031 - protein, 469 aa, Artificial Sequence; identical to SEQ ID NO: 22930
  neuraminidase__InfluenzaA__AFN19612

SEQ ID NO: 23032 - protein, 469 aa, Artificial Sequence; identical to SEQ ID NO: 22146
  neuraminidase__InfluenzaA__AFN19614

SEQ ID NO: 23033 - protein, 469 aa, Artificial Sequence
  neuraminidase__InfluenzaA__AFN19618
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSNEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23034 - protein, 469 aa, Artificial Sequence; identical to SEQ ID NO: 22922
  neuraminidase__InfluenzaA__AFN19620

SEQ ID NO: 23035 - protein, 469 aa, Artificial Sequence; identical to SEQ ID NO: 22958
  neuraminidase__InfluenzaA__AFN19624

SEQ ID NO: 23036 - protein, 469 aa, Artificial Sequence; identical to SEQ ID NO: 22922
  neuraminidase__InfluenzaA__AFN19630

SEQ ID NO: 23037 - protein, 469 aa, Artificial Sequence
  neuraminidase__InfluenzaA__AFN19632
MNPNQKIITIGSVSLTISTICFFMQIAILITTVTLHFKQYEFNSPPNNQVMLCEPTIIERNITEIVYLTNTTIEKEICPKPTEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23038 - protein, 469 aa, Artificial Sequence
  neuraminidase__InfluenzaA__AFN19634
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTSYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23039 - protein, 469 aa, Artificial Sequence
  neuraminidase__InfluenzaA__AFN19636
MNPNQKIITIGSVSLTISTICFFMQIAILITTVTLHFKQYEFNSPPNNQVMLCEPTIIERNITEIVYLTNTIIEKEICPKPTEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23040 - protein, 469 aa, Artificial Sequence; identical to SEQ ID NO: 23039
  neuraminidase__InfluenzaA__AFN19638

SEQ ID NO: 23041 - protein, 469 aa, Artificial Sequence; identical to SEQ ID NO: 22922
  neuraminidase__InfluenzaA__AFN19640

SEQ ID NO: 23042 - protein, 469 aa, Artificial Sequence
  neuraminidase__InfluenzaA__AFN19642
MNPNQKIITIGSVSLTISTICFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNTVSDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 23043 - protein, 469 aa, Artificial Sequence; identical to SEQ ID NO: 23039
  neuraminidase__InfluenzaA__AFN19644

SEQ ID NO: 23044 - protein, 469 aa, Artificial Sequence
  neuraminidase__InfluenzaA__AFN19646
MNPNQKIITIGSVSLTISTICFFIQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVNRSDRSGYSGIFSVEGKSCINRCFYVELIRGRKEETEVLWTSNSIVVFCGTSGTYGTGSWPDGADLNLMPI

SEQ ID NO: 23045 - protein, 469 aa, Artificial Sequence; identical to SEQ ID NO: 22922
  neuraminidase__InfluenzaA__AFN19648

SEQ ID NO: 23046 - protein, 469 aa, Artificial Sequence; identical to SEQ ID NO: 22958
  neuraminidase__InfluenzaA__AFN19650

SEQ ID NO: 23047 - protein, 469 aa, Artificial Sequence
  neuraminidase__InfluenzaA__AFN19652
MNPNQKIITIGSVSLTISTICFFMQIAILITTVTLHFKQYEFNSPPNNQVMLCEPTIIERNITEVVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23048 - protein, 469 aa, Artificial Sequence
  neuraminidase__InfluenzaA__AFN19654
MNPNQKIITIGSVSLTISTICFFMQIAILITTVTLHFKQYEFNSPPNNQVMLCEPTIIERNITEIVYLTNTTIEKETCPKPTEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23049 - protein, 469 aa, Artificial Sequence; identical to SEQ ID NO: 22922
  neuraminidase__InfluenzaA__AFN19656

SEQ ID NO: 23050 - protein, 469 aa, Artificial Sequence; identical to SEQ ID NO: 22146
  neuraminidase__InfluenzaA__AFN19658

SEQ ID NO: 23051 - protein, 469 aa, Artificial Sequence; identical to SEQ ID NO: 23039
  neuraminidase__InfluenzaA__AFN19660

SEQ ID NO: 23052 - protein, 469 aa, Artificial Sequence; identical to SEQ ID NO: 22146
  neuraminidase__InfluenzaA__AFN19662

SEQ ID NO: 23053 - protein, 469 aa, Artificial Sequence
  neuraminidase__InfluenzaA__AFN19664
MNPNQKIITIGSVSLTISTICFFMQIAILITTVTLHFKQYEFNSPPNNQVMLCEPTIIERNITEIVYLTNNTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23054 - protein, 469 aa, Artificial Sequence
  neuraminidase__InfluenzaA__AFN19666
MNPNQKIITIGSVSLTISTICFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVNRSDRSGYSGIFSVEGKSCINRCFYVELIRGRKEETEVLWTSNSIVVFCGTSGTYGTGSWPDGADLNLMPI

SEQ ID NO: 23055 - protein, 469 aa, Artificial Sequence
  neuraminidase__InfluenzaA__AFN19668
MNPNQKIITIGSVSLTISTICFFMQIAILITTVTLHFKQYEFNSPPNNQVMLCEPTIIERNMTEIVYLTNTTIEKEICPKPAEYRNWSKPQCDITGFAPFSKDNSIRLSAGGDIWVTREPYVSCDPDKCYQFALGQGTTLNNEHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 23056 - protein, 469 aa, Artificial Sequence; identical to SEQ ID NO: 22958
  neuraminidase__InfluenzaA__AFN19670

SEQ ID NO: 23057 - protein, 469 aa, Artificial Sequence; identical to SEQ ID NO: 22146
  neuraminidase__InfluenzaA__AFN19673

SEQ ID NO: 23058 - protein, 469 aa, Artificial Sequence; identical to SEQ ID NO: 22922
  neuraminidase__InfluenzaA__AFN19675

SEQ ID NO: 23059 - protein, 469 aa, Artificial Sequence
  neuraminidase__InfluenzaA__AFN19677
MNPNQKIITIGSVSLTISIICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23060 - protein, 469 aa, Artificial Sequence; identical to SEQ ID NO: 22958
  neuraminidase__InfluenzaA__AFN19683

SEQ ID NO: 23061 - protein, 469 aa, Artificial Sequence; identical to SEQ ID NO: 22922
  neuraminidase__InfluenzaA__AFN19685

SEQ ID NO: 23062 - protein, 469 aa, Artificial Sequence; identical to SEQ ID NO: 22922
  neuraminidase__InfluenzaA__AFN19687

SEQ ID NO: 23063 - protein, 469 aa, Artificial Sequence; identical to SEQ ID NO: 22922
  neuraminidase__InfluenzaA__AFN19689

SEQ ID NO: 23064 - protein, 469 aa, Artificial Sequence; identical to SEQ ID NO: 22146
  neuraminidase__InfluenzaA__AFN19691

SEQ ID NO: 23065 - protein, 469 aa, Artificial Sequence
  neuraminidase__InfluenzaA__AFN19693
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCAVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSNCLDPNNEEGGHGVKGWAFDDGNDVWMGRTINETSRLGYETFKVIEGWSNPKSKLQINRQVIVDRGNRSGYSGIFSVEGKNCINRCFYVELIRGRKEETEVLWTSNSIVVFCGTSGTYGTGSWPDGADLNLMPI

SEQ ID NO: 23066 - protein, 469 aa, Artificial Sequence
  neuraminidase__InfluenzaA__AFN19697
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKETLRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23067 - protein, 469 aa, Artificial Sequence; identical to SEQ ID NO: 22922
  neuraminidase__InfluenzaA__AFN19699

SEQ ID NO: 23068 - protein, 469 aa, Artificial Sequence; identical to SEQ ID NO: 22958
  neuraminidase__InfluenzaA__AFN19701

SEQ ID NO: 23069 - protein, 469 aa, Artificial Sequence
  neuraminidase__InfluenzaA__AFN19703
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLDNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23070 - protein, 469 aa, Artificial Sequence; identical to SEQ ID NO: 20257
  neuraminidase__InfluenzaA__AFN19711

SEQ ID NO: 23071 - protein, 469 aa, Artificial Sequence
  neuraminidase__InfluenzaA__AFN19721
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPMECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23072 - protein, 469 aa, Artificial Sequence; identical to SEQ ID NO: 21078
  neuraminidase__InfluenzaA__AFN19731

SEQ ID NO: 23073 - protein, 469 aa, Artificial Sequence; identical to SEQ ID NO: 20257
  neuraminidase__InfluenzaA__AFN19737

SEQ ID NO: 23074 - protein, 469 aa, Artificial Sequence
  neuraminidase__InfluenzaA__AFN19747
MNPNQKIITIGSVCMTIGMANLILQIGNIISIWISHSIQLGNQNQIETCNQSVITHENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGANRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23075 - protein, 469 aa, Artificial Sequence; identical to SEQ ID NO: 20257
  neuraminidase__InfluenzaA__AFN19749

SEQ ID NO: 23076 - protein, 469 aa, Artificial Sequence; identical to SEQ ID NO: 20257
  neuraminidase__InfluenzaA__AFN19759

SEQ ID NO: 23077 - protein, 469 aa, Artificial Sequence
  neuraminidase__InfluenzaA__AFN19769
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNRAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23078 - protein, 469 aa, Artificial Sequence; identical to SEQ ID NO: 20257
  neuraminidase__InfluenzaA__AFN19783

SEQ ID NO: 23079 - protein, 469 aa, Artificial Sequence; identical to SEQ ID NO: 20958
  neuraminidase__InfluenzaA__AFN19793

SEQ ID NO: 23080 - protein, 469 aa, Artificial Sequence; identical to SEQ ID NO: 20257
  neuraminidase__InfluenzaA__AFN19807

SEQ ID NO: 23081 - protein, 469 aa, Artificial Sequence
  neuraminidase__InfluenzaA__AFN19809
MNPNQKIITIGSVCMIIGMANLMLQIGNIISIWISHSIQLGNQNQIETCNQSVITYENNTWVNQTYVNISNTNFAAGQSVISVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSTNGANGVKGFSFKYGNGVWIGRTKSISSRNGFEMIWDPNGWTGTDNKFSIKQDIVGINEWSGYSGSFVQHPELTGLDCIRPCFWVELIRGRPKENTIWTSGSSISFCGVNSDTVGWSWPDGAELPFTIDK

SEQ ID NO: 23082 - protein, 469 aa, Artificial Sequence; identical to SEQ ID NO: 21080
  neuraminidase__InfluenzaA__AFN19815

SEQ ID NO: 23083 - protein, 469 aa, Artificial Sequence
  neuraminidase__InfluenzaA__AFN19833
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWKNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23084 - protein, 469 aa, Artificial Sequence; identical to SEQ ID NO: 20716
  neuraminidase__InfluenzaA__AFN19851

SEQ ID NO: 23085 - protein, 469 aa, Artificial Sequence; identical to SEQ ID NO: 20257
  neuraminidase__InfluenzaA__AFN19857

SEQ ID NO: 23086 - protein, 469 aa, Artificial Sequence
  neuraminidase__InfluenzaA__AFN19867
MNPNQKIITIGSVCMTIGMANLILQIGNIISIWISHSIQIGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIITDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23087 - protein, 469 aa, Artificial Sequence; identical to SEQ ID NO: 20709
  neuraminidase__InfluenzaA__AFN19877

SEQ ID NO: 23088 - protein, 469 aa, Artificial Sequence; identical to SEQ ID NO: 20257
  neuraminidase__InfluenzaA__AFN19887

SEQ ID NO: 23089 - protein, 469 aa, Artificial Sequence
  neuraminidase__InfluenzaA__AFN19897
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPCNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23090 - protein, 469 aa, Artificial Sequence; identical to SEQ ID NO: 20257
  neuraminidase__InfluenzaA__AFN19907

SEQ ID NO: 23091 - protein, 469 aa, Artificial Sequence; identical to SEQ ID NO: 20716
  neuraminidase__InfluenzaA__AFN19917

SEQ ID NO: 23092 - protein, 469 aa, Artificial Sequence
  neuraminidase__InfluenzaA__AFN19923
MNPNQKIITIGSVCMTIGMANLILQIGNIISIWISHSIQLGNQSQIETCNQNVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23093 - protein, 469 aa, Artificial Sequence; identical to SEQ ID NO: 20257
  neuraminidase__InfluenzaA__AFN19933

SEQ ID NO: 23094 - protein, 469 aa, Artificial Sequence; identical to SEQ ID NO: 20716
  neuraminidase__InfluenzaA__AFN19943

SEQ ID NO: 23095 - protein, 469 aa, Artificial Sequence
  neuraminidase__InfluenzaA__AFN19953
MNPNQKIITIGSVCMTIGMANLILQIGNIISIWISHSIQLGNQSQIETCNQRVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVEINEWSGYSGSFVQHPELTGLDCIRPCFWVELIRGRPKENTIWTSGSSISFCGVNSDTVGWSWPDGAELPFTIDK

SEQ ID NO: 23096 - protein, 469 aa, Artificial Sequence
  neuraminidase__InfluenzaA__AFN19967
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRSNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23097 - protein, 469 aa, Artificial Sequence
  neuraminidase__InfluenzaA__AFN19973
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGSSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23098 - protein, 469 aa, Artificial Sequence; identical to SEQ ID NO: 20257
  neuraminidase__InfluenzaA__AFN19979

SEQ ID NO: 23099 - protein, 469 aa, Artificial Sequence
  neuraminidase__InfluenzaA__AFN19985
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSVSSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23100 - protein, 469 aa, Artificial Sequence
  neuraminidase__InfluenzaA__AFN19995
MNPNQKIITIGSVCMTIGMANLILQIGNIISIWISHSIQLGNQSQTETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23101 - protein, 469 aa, Artificial Sequence; identical to SEQ ID NO: 20257
  neuraminidase__InfluenzaA__AFN20001

SEQ ID NO: 23102 - protein, 469 aa, Artificial Sequence
  neuraminidase__InfluenzaA__AFN20013
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCDPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23103 - protein, 469 aa, Artificial Sequence
  neuraminidase__InfluenzaA__AFN20020
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGLNEWSGYSGSFVQHPELTGLDCIRPCFWVELIRGRPKENTIWTSGSSISFCGVNSDTVGWSWPDGAELPFTIDK

SEQ ID NO: 23104 - protein, 469 aa, Artificial Sequence; identical to SEQ ID NO: 20257
  neuraminidase__InfluenzaA__AFN20022

SEQ ID NO: 23105 - protein, 469 aa, Artificial Sequence
  neuraminidase__InfluenzaA__AFN20035
MNPNQKIITIGSVCMTIGIANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23106 - protein, 469 aa, Artificial Sequence; identical to SEQ ID NO: 20257
  neuraminidase__InfluenzaA__AFN20041

SEQ ID NO: 23107 - protein, 469 aa, Artificial Sequence; identical to SEQ ID NO: 20257
  neuraminidase__InfluenzaA__AFN20047

SEQ ID NO: 23108 - protein, 469 aa, Artificial Sequence; identical to SEQ ID NO: 21080
  neuraminidase__InfluenzaA__AFN20063

SEQ ID NO: 23109 - protein, 469 aa, Artificial Sequence
  neuraminidase__InfluenzaA__AFN20077
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23110 - protein, 469 aa, Artificial Sequence; identical to SEQ ID NO: 20257
  neuraminidase__InfluenzaA__AFN20083

SEQ ID NO: 23111 - protein, 469 aa, Artificial Sequence
  neuraminidase__InfluenzaA__AFN20094
MNPNQKIITIGSVCMTIGMANLILQIGNIISIWISHSIQLGNQSQIETCNQSVIIYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKAGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTMGWSWPDGAELPFTIDK

SEQ ID NO: 23112 - protein, 469 aa, Artificial Sequence; identical to SEQ ID NO: 20716
  neuraminidase__InfluenzaA__AFN20100

SEQ ID NO: 23113 - protein, 469 aa, Artificial Sequence
  neuraminidase__InfluenzaA__AFN20114
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCSPVSSNGANGVKGFSFKYGNGVWIGRTKSTSSRNGFEMIWDPNGWTGTDNSFSMKQDIVGINEWSGYSGSFVQHPELTGLDCIRPCFWVELIRGRPKENTVWTSGSSISFCGVNSDTVGWSWPDGAELPFTIDK

SEQ ID NO: 23114 - protein, 469 aa, Artificial Sequence
  neuraminidase__InfluenzaA__AFN20128
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIRSWRNNILRTQESECACVNGSCFTIMTDGPSDGQASYKIFRIEKGKIIKSVEMNAPNYHYEECSCYPDSSEITCVCRDNWHGSNRPWVSFNQNLEYQIGYICSGIFGDNPRSNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23115 - protein, 469 aa, Artificial Sequence; identical to SEQ ID NO: 20257
  neuraminidase__InfluenzaA__AFN87935

SEQ ID NO: 23116 - protein, 469 aa, Artificial Sequence
  neuraminidase__InfluenzaA__AFN87937
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSTSSRNGFEMIWDPNGWTGTDNSFSMKQDIVGINEWSGYSGSFVQHPELTGLDCIRPCFWVELIRGRPKENTVWTSGSSISFCGVNSDTVGWSWPDGAELPFTIDK

SEQ ID NO: 23117 - protein, 469 aa, Artificial Sequence
  neuraminidase__InfluenzaA__AFN87940
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSTSSRNGFEMIWDPNGWTGTDNSFSIKQDIVGINEWSGYSGSFVQHPELTGLDCIRPCFWVELIRGRPKENTIWTSGSSISFCGVNSDTVGWSWPDGAELPFTIDK

SEQ ID NO: 23118 - protein, 469 aa, Artificial Sequence; identical to SEQ ID NO: 16738
  neuraminidase__InfluenzaA__AFN87942

SEQ ID NO: 23119 - protein, 469 aa, Artificial Sequence; identical to SEQ ID NO: 23116
  neuraminidase__InfluenzaA__AFN87944

SEQ ID NO: 23120 - protein, 469 aa, Artificial Sequence
  neuraminidase__InfluenzaA__AFN87946
MNPNQKIITIGSVCMTIGMANLTLQIGNIISIWISHSIQLGNQNQIETCNQSVINYENNTWVNQTYVNISNTNFAAGQSVVSVKLAGNSSLCPVSGWAIYSKDNSIRIGSKGDVFVIREPFVSCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEVTCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23121 - protein, 469 aa, Artificial Sequence
  neuraminidase__InfluenzaA__AFN87948
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSTSSRNGFEMIWDPNGWTGTDNSFSIKQDIVGINEWSGYSGSFVQHPELTGLDCIRPCFWVELIRGRPKENTIWTSGSSISFCGVNSDIVGWSWPDGAELPFTIDK

SEQ ID NO: 23122 - protein, 469 aa, Artificial Sequence
  neuraminidase__InfluenzaA__AFN87950
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLKYQIGYICSGIFGDNPRPNDKTGSCGPVSSNGANGVKGFSFKYGNGVWIGRTKSISSRKGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 23123 - protein, 469 aa, Artificial Sequence; identical to SEQ ID NO: 20709
  neuraminidase__InfluenzaA__AFN87952

SEQ ID NO: 23124 - protein, 469 aa, Artificial Sequence
  neuraminidase__InfluenzaA__AFN87954
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTMGWSWPDGAELPFTIDK

SEQ ID NO: 23125 - protein, 469 aa, Artificial Sequence
  neuraminidase__InfluenzaA__AFN87956
MNPNQKIITIGSVCMTIGMANLILQIGNIISIWISHSIQLGNQSQIETCNQSVITYENNTWVNQTYVNISNTNFAAGQSVVSVKLVGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGTNEWSGYSGSFVQHPELTGLDCIRPCFWVELIRGRPKENTIWTSGSSISFCGVNSDTVGWSWPDGAELPFTIDN

SEQ ID NO: 23126 - protein, 469 aa, Artificial Sequence
  neuraminidase__InfluenzaA__AFN87958
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFKIEKGKIVKSVEMNAPNYHYEECSCYPDSSEITCVCRDNWHGSNRPWVSFNQNLEYQIGYICSGIFGDNPRPNDKTGSCGPASSNGANGVKGFSFKYGNGVWIGRTKSTSSRNGFEMIWDPNGWTGTDNSFSMKQDIVGINEWSGYSGSFVQHPELTGLDCIRPCFWVELIRGRPKENTVWTSGSSISFCGVNSDTVGWSWPDGAELPFTIDK

SEQ ID NO: 23127 - protein, 469 aa, Artificial Sequence
  neuraminidase__InfluenzaA__AFN87960
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWIELIRGRPKENTIWTSGSSISFCGVNSDTVGWSWPDGAELPFTIDK

SEQ ID NO: 23128 - protein, 470 aa, Artificial Sequence
  neuraminidase__InfluenzaA__AFO64805
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPNNGAASYKIFKIEKGKVTKSIELNAPNSHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 23129 - protein, 470 aa, Artificial Sequence
  neuraminidase__InfluenzaA__AFO64816
MNPNQKIITIGSICMAIGIISLILQIGNIVSIWISHSIQTGSQNYTGICNQRIITYENSTWVNQTYVNINNTNVVAGQDTTSVALAGNSSLCPISGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWRRRILRTQESECVCVNGSCFTIMTDGPNNGPASYKIFKIEKGKVTKSIELDAPNSHYEECSCYPDAGTVMCVCRDNWHGSNRPWVSFNQNLDYQIGYICSGVFGDNPRPKDGKGSCDPVTVDGADGVKGFSYRYGNGVWIGRTKSNSSRRGFEMIWDPNGWTDTDSKFLVKQDVVAMTDWSGYSGSFVQHPELTGLDCMRPCFWVELIRGRPRENTTIWTSGSSISFCGVNGDTANWSWPDGAELPFTIDK

SEQ ID NO: 23130 - protein, 470 aa, Artificial Sequence
  neuraminidase__InfluenzaA__AFO64827
MNPNQKIITIGSISMAIGIISLILQIGNIISIWVSHSIQTGSQNHTGICNQRIITYENSTWVNQTYVNINNTNVIAGKDKTSVTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDDGAVAVLKYNGIITETIKSWKKRILRTQESECVCVNGSCFTIMTDGPSNGAASYRIFKIEKGKVTKSIELDAPNSHYEECSCYPDTGTVMCVCRDNWHGSNRPWVSFNQNLDYQIGYICSGVFGDNPRPKDGKGSCDPVTVDGADGVKGFSYRYGNGVWIGRTKSNRFRKGFEMIWDPNGWTDTDSDFLVKQDVVAMTDWSGYSGSFVQHPELTGLDCMRPCFWVELVRGRPRENTTIWTSGSSISFCGVNSDTANWSWPDGAELPFTIDK

SEQ ID NO: 23131 - protein, 470 aa, Artificial Sequence
  neuraminidase__InfluenzaA__AFO64838
MNPNQKIITIGSISMAIGIISLILQIGNIISIWASHSIQTGSQNHTGICNQRIITYENSTWVNQTYVNINNTNVVAGKDKTSVTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCVNGSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSDTANWSWPDGAELPFTIDK

SEQ ID NO: 23132 - protein, 470 aa, Artificial Sequence
  neuraminidase__InfluenzaA__AFO64849
MNPNQKIITIGSISMAIGIISLILQIGNIISIWASHSIQTGSQNHTGICNQRIITYENSTWVNQTYVNINNTNVVAGKDKTSVTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKQILRTQESECVCVNGSCFTIMTDGPSNGAASYRIFKIEKGKITKSIELDAPNSHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSVKQDVVAMTDWSGYSGSFVQHPELTGLDCMRPCFWVELVRGRPRENATIWTSGSSISFCGVNSDTANWSWPDGAELPFTIDK

SEQ ID NO: 23133 - protein, 470 aa, Artificial Sequence; identical to SEQ ID NO: 14968
  neuraminidase__InfluenzaA__AFO64860

SEQ ID NO: 23134 - protein, 470 aa, Artificial Sequence
  neuraminidase__InfluenzaA__AFO64871
MNPNQKIITIGSISIAIGIISLILQIGNIISIWASHSIQTGSQNHTGVCNQRIITYENSTWVNQTYVNINNTNVVAGKDKTSMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKRILRTQESECVCMNGSCFTIMTDGPSNGAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMRQDIVAMTDWSGYSGSFVQHPELTGLDCMRPCFWVELVRGLPRENTTIWTSGSSISFCGVNSDTANWSWPDGAELPFTIDK

SEQ ID NO: 23135 - protein, 470 aa, Artificial Sequence
  neuraminidase__InfluenzaA__AFO64882
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNSHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGRPRENTTIWTSGSSISFCGVNSDTANWSWPDGAELPFTIDK

SEQ ID NO: 23136 - protein, 470 aa, Artificial Sequence
  neuraminidase__InfluenzaA__AFO64893
MNPNQKIITIGSISVAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSDGAASYKIFKIEKGKVTKSIELNAPNSHYEECSCYPDTGTVMCVCRDNWHGSNRPWVSFNQNLDYQIGYICSGVFGDNPRPKDGEGSCNPVTVDGADGVKGFSYKYGNGVWIGRTKSNRFRKGFEMIWDPNGWTDTDSDFSVKQDVVAITDWSGYSGSFVQHPELTGLDCIRPCFWVELVRGRPRENTTIWTSGSSISFCGVNSDTANWSWPDGAELPFTIDK

SEQ ID NO: 23137 - protein, 470 aa, Artificial Sequence
  neuraminidase__InfluenzaA__AFO64904
MNPNQKIITIGSISVAIGIISLILQIGNIISMWASHSIQTGSQNYTGICNQRIITYENNTWVNQTYVNINNTNVVAGKDKISMTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 23138 - protein, 470 aa, Artificial Sequence
  neuraminidase__InfluenzaA__AFO65019
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNSHYEECSCYPDTGTVMCVCRDNWHGSNRPWVSFNQNLDYQIGYICSGVFGDNPRPKDGEGSCNPVTADGADGVKGFSYKYGNGVWIGRTKSNRLRKGFEMIWDPNGWTDTDSDFSVKQDVVAITDWSGYSGSFVQHPELTGLDCIRPCFWVELVRGRPRENTTIWTSGSSISFCGVNSDTANWSWPDGAELPFTIDK

SEQ ID NO: 23139 - protein, 470 aa, Artificial Sequence; identical to SEQ ID NO: 16453
  neuraminidase__InfluenzaA__AFO65030

SEQ ID NO: 23140 - protein, 470 aa, Artificial Sequence
  neuraminidase__InfluenzaA__AFO65041
MNPNQKIITIGSISIAIGIISLMLQIGNIISIWASHSIQTGSQNHTGVCNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 23141 - protein, 470 aa, Artificial Sequence
  neuraminidase__InfluenzaA__AFO65052
MNPNQKIITIGSISIAIGIISLMLQIGNIISIWASHSIQTGSQNHTGVCNQRIITYENSTWVNHTYVNINNTNVIAGKDKTSMTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACNDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 23142 - protein, 470 aa, Artificial Sequence; identical to SEQ ID NO: 14828
  neuraminidase__InfluenzaA__AFO66139

SEQ ID NO: 23143 - protein, 470 aa, Artificial Sequence
  neuraminidase__InfluenzaA__AFO66150
MNPNQKIITIGSISVAIGIISLILQIGNIISIWASHSIQTGSQNYTGICNQRIITYENRTWVNQTYVNINNTNVVAGKDKTSMTLAGNSSLCPIRGWAIYTKDNSIRIGSKGDVFVIREPFISCSHLECRTFFLTQGALLNDKHSNGTIKDRSPFRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRIRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 23144 - protein, 470 aa, Artificial Sequence
  neuraminidase__InfluenzaA__AFO66161
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVICVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDVVAITDWSGYSGSFVQHPELTGLDCIRPCFWVELVRGLPKENTTIWTSGSSISFCGVNSDTANWSWPDGAELPFTIDK

SEQ ID NO: 23145 - protein, 470 aa, Artificial Sequence
  neuraminidase__InfluenzaA__AFO66172
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCMNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 23146 - protein, 470 aa, Artificial Sequence; identical to SEQ ID NO: 14930
  neuraminidase__InfluenzaA__AFO66183

SEQ ID NO: 23147 - protein, 470 aa, Artificial Sequence
  neuraminidase__InfluenzaA__AFO66194
MNPNQKIITIGSISIAIGIISLMLQIGNIISIWASHSIQTGSQNHTGVCNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGANGVKGFSYKYGNGVWIGRTKSNRLRKGFEMIWDPNGWTDTDSDFSVKQDIVAITDWSGYSGSFVQHPELTGLDCIRPCFWVELVRGLPKENTTIWTSGSSISFCGVNSDTANWSWPDGAELPFTIDK

SEQ ID NO: 23148 - protein, 469 aa, Artificial Sequence; identical to SEQ ID NO: 16555
  neuraminidase__InfluenzaA__AFO66205

SEQ ID NO: 23149 - protein, 470 aa, Artificial Sequence; identical to SEQ ID NO: 14415
  neuraminidase__InfluenzaA__AFO66216

SEQ ID NO: 23150 - protein, 470 aa, Artificial Sequence; identical to SEQ ID NO: 14386
  neuraminidase__InfluenzaA__AFO66227

SEQ ID NO: 23151 - protein, 470 aa, Artificial Sequence
  neuraminidase__InfluenzaA__AFO66238
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKQILRTQESECVCMNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 23152 - protein, 470 aa, Artificial Sequence
  neuraminidase__InfluenzaA__AFO66249
MNPNQKIITIGSISIAIGIISLMLQIGNIISIWASHSIQTGSQNHTGICNQRIITYENSTWVNHTYVNINNTNVVAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 23153 - protein, 470 aa, Artificial Sequence
  neuraminidase__InfluenzaA__AFP33330
MNPNQKIITIGSISVAIGIISLILQIGNIISIWASHSIQAGSQNYTGICNQKIITYENRTWVNQTYVNINNTNVVAGKDKTSMTLAGNSSLCPIRGWAIYTKDNSIRIGSKGDVFVIREPFISCSHLECRTFFLTQGALLNDKHSNGTIKDRSPFRALMSCPLGEAPSPYNSRFESVAWSASACHDGLGWLTIGISGPDNGAVAVLKYNGIITETIKSWKKQILRTQESECVCVNGSCFTIMTDGPSNRAASYRIFKIEKGRVTKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNRLRKGFEMIWDPNGWTDTDSDFSMKQDVVAMTDWSGYSGSFVQHPELTGLDCMRPCFWVELVRGLPRENTTIWTSGSSISFCGVNSETANWSWPDGAELPFTIDK

SEQ ID NO: 23154 - protein, 470 aa, Artificial Sequence
  neuraminidase__InfluenzaA__AFP33331
MNPNQKIITIGSISIAIGIISLMLQIGNIISIWASHSIQTGSQNHTGICNQRIITYENSTWVNHTYVNINNTNVIAGKDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITETIKSWKKRILRTQESECVCVNGSCFTIMTDGPSNGAASYKIFKIEKGKVTKSIELNAPNFHYEECSCYPDTGTVMCVCRDNWHGSNRPWVSFNQNLDYQIGYICSGVFGDNPRPKDGEGSCNPVTVDGADGVKGFSYKYGNGVWIGRTKSNRLRKGFEMIWDPNGWTDTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 23155 - protein, 469 aa, Artificial Sequence; identical to SEQ ID NO: 21143
  neuraminidase__InfluenzaA__AFQ32576

SEQ ID NO: 23156 - protein, 469 aa, Artificial Sequence
  neuraminidase__InfluenzaA__AFQ37282
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTGGSSISFCGVNSDTVGWSWPDGAELPFTIDK

SEQ ID NO: 23157 - protein, 469 aa, Artificial Sequence
  neuraminidase__InfluenzaA__AFQ55691
MNPNQKIITIGVVNTTLSTIALLIGVGNLVFNTVIHEKIGDHQTVTHPTTTTPAIPNCSDTIITYNNTIINNITTTIITEAERPFKSPLPLCPFRGFFPFHKDNAIRLGENKDVIVTREPYVSCDNDNCWSFALAQGALLGTKHSNGTIKDRTPYRSLIRFPIGTAPVLGNYKEICIAWSSSSCFDGKEWMHVCMTGNDNDASAQIIYAGKMTDSIKSWRKDILRTQESECQCIDGTCVVAVTDGPAASSADHRIYWIREGKIIKYEDVPKTKIQHLEECSCYVDVDVYCICRDNWKGSNRPWMRINNETILETGYVCSKFHSDTPRPADPSTVSCDSPSNVNGGPGVKGFGFKAGNDVWLGRTVSTSGRSGFEIIKVTEGWINSPNHAKSITQTLMSNNDWSGYSGSFIIKTKDCFQPCFYVELIRGRPNKNDDVSWTSNSIVTFCGLDNEPGSGNWPDGSNIGFMPK

SEQ ID NO: 23158 - protein, 469 aa, Artificial Sequence
  neuraminidase__InfluenzaA__AFR68156
MNPNQKIITIGSVCMTIGMANLILQIGNIISIWISHSIQLRNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23159 - protein, 469 aa, Artificial Sequence; identical to SEQ ID NO: 23158
  neuraminidase__InfluenzaA__AFR68166

SEQ ID NO: 23160 - protein, 469 aa, Artificial Sequence
  neuraminidase__InfluenzaA__AFR68176
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVASWSKDILRTQESECVCINGTCAVVMTDGSASGKADTKILFIKEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTINETSRLGYETFKVIEGWSNPKSKLQINRQVIVDRGNRSGYSGIFSVEGKNCINRCFYVELIRGRKEETEVLWTSNSIVVFCGTSGTYGTGSWPDGADLNLMPI

SEQ ID NO: 23161 - protein, 469 aa, Artificial Sequence; identical to SEQ ID NO: 16738
  neuraminidase__InfluenzaA__AFR84677

SEQ ID NO: 23162 - protein, 469 aa, Artificial Sequence; identical to SEQ ID NO: 17625
  neuraminidase__InfluenzaA__AFR84687

SEQ ID NO: 23163 - protein, 469 aa, Artificial Sequence; identical to SEQ ID NO: 16728
  neuraminidase__InfluenzaA__AFR84696

SEQ ID NO: 23164 - protein, 469 aa, Artificial Sequence; identical to SEQ ID NO: 16738
  neuraminidase__InfluenzaA__AFR84706

SEQ ID NO: 23165 - protein, 469 aa, Artificial Sequence; identical to SEQ ID NO: 16728
  neuraminidase__InfluenzaA__AFR84716

SEQ ID NO: 23166 - protein, 469 aa, Artificial Sequence; identical to SEQ ID NO: 16728
  neuraminidase__InfluenzaA__AFR84726

SEQ ID NO: 23167 - protein, 469 aa, Artificial Sequence; identical to SEQ ID NO: 16728
  neuraminidase__InfluenzaA__AFR84736

SEQ ID NO: 23168 - protein, 469 aa, Artificial Sequence; identical to SEQ ID NO: 16728
  neuraminidase__InfluenzaA__AFR84746

SEQ ID NO: 23169 - protein, 469 aa, Artificial Sequence; identical to SEQ ID NO: 16728
  neuraminidase__InfluenzaA__AFR84756

SEQ ID NO: 23170 - protein, 469 aa, Artificial Sequence; identical to SEQ ID NO: 16728
  neuraminidase__InfluenzaA__AFR84766

SEQ ID NO: 23171 - protein, 469 aa, Artificial Sequence; identical to SEQ ID NO: 16728
  neuraminidase__InfluenzaA__AFR84776

SEQ ID NO: 23172 - protein, 469 aa, Artificial Sequence; identical to SEQ ID NO: 16728
  neuraminidase__InfluenzaA__AFR84786

SEQ ID NO: 23173 - protein, 469 aa, Artificial Sequence; identical to SEQ ID NO: 16728
  neuraminidase__InfluenzaA__AFR84796

SEQ ID NO: 23174 - protein, 469 aa, Artificial Sequence; identical to SEQ ID NO: 16738
  neuraminidase__InfluenzaA__AFR84806

SEQ ID NO: 23175 - protein, 469 aa, Artificial Sequence; identical to SEQ ID NO: 16728
  neuraminidase__InfluenzaA__AFR84816

SEQ ID NO: 23176 - protein, 469 aa, Artificial Sequence; identical to SEQ ID NO: 16738
  neuraminidase__InfluenzaA__AFR84826

SEQ ID NO: 23177 - protein, 469 aa, Artificial Sequence
  neuraminidase__InfluenzaA__AFR84836
MNPNQKIITIGSVCMTIGMANLILQIGNIISIWISHSIQLGNQNQIETCNQSVITYENNTWVNQTYVNISNTNFAAGQSVVSVKLAGNSSLCPVGGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTETDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23178 - protein, 469 aa, Artificial Sequence; identical to SEQ ID NO: 17542
  neuraminidase__InfluenzaA__AFR84846

SEQ ID NO: 23179 - protein, 469 aa, Artificial Sequence; identical to SEQ ID NO: 16738
  neuraminidase__InfluenzaA__AFR84856

SEQ ID NO: 23180 - protein, 469 aa, Artificial Sequence
  neuraminidase__InfluenzaA__AFR84866
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPFRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23181 - protein, 469 aa, Artificial Sequence; identical to SEQ ID NO: 17446
  neuraminidase__InfluenzaA__AFR84876

SEQ ID NO: 23182 - protein, 469 aa, Artificial Sequence; identical to SEQ ID NO: 17542
  neuraminidase__InfluenzaA__AFR84895

SEQ ID NO: 23183 - protein, 469 aa, Artificial Sequence; identical to SEQ ID NO: 17542
  neuraminidase__InfluenzaA__AFR84905

SEQ ID NO: 23184 - protein, 469 aa, Artificial Sequence; identical to SEQ ID NO: 17542
  neuraminidase__InfluenzaA__AFR84915

SEQ ID NO: 23185 - protein, 469 aa, Artificial Sequence; identical to SEQ ID NO: 17542
  neuraminidase__InfluenzaA__AFR84925

SEQ ID NO: 23186 - protein, 450 aa, Artificial Sequence
  neuraminidase__InfluenzaA__AFU83119
MNPNQKIITIGSVSLTIATVCFLMQIAILATTVTLHFKQNECSIPSSNQVVPCEPIIVERNVTEYRDWSKPQCQITGFAPFSKDNSIRLSAGGDIWVTREPYVSCSPDKCYQFALGQGTTLDNKHSNGTIHDRIPHRTLLMNELGVPFHLGTKQVCIAWSSSSCHDGRAWLHVCVTGDDRNATASFIYDGVLVDSIGSWSQNILRTQESECVCINGTCTVVMTDGSASGRADTRILFIKEGKIVHVSPLSGSAQHIEECSCYPRYPDVRCVCRDNWKGSNRPIIDISMADYGIDSSYVCSGLVGDTPRNDDSSSNSNCKDPNNERGNPGVKGWAFDYGNDVWMGRTISKDSRSGYETFRVIGGWTIANSKSQVNRQVIVDNNNWSGYSGIFSVEGKSCINRCFYVELIRGRPQETRVWWTSNSIVAFCGTSGTYGTGSWPDGANINFMPI

SEQ ID NO: 23187 - protein, 469 aa, Artificial Sequence
  neuraminidase__InfluenzaA__AFV53208
MNPNQKIITIGSVSLTIATVCFLIQIAILVTTVTLHFKQHECDSPASNQVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCITGDDKNATASFIYDGRLMDSIGSWSQNILRTQESECVCINGTCTVVMTDGSASGRADTRILFIEEGKIVHISPLSGSAQHVEECSCYPRYPGVRCICRDNWKGSNRPVIDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINFMPI

SEQ ID NO: 23188 - protein, 469 aa, Artificial Sequence
  neuraminidase__InfluenzaA__AFV53219
MNPNQKTITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTINKESRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 23189 - protein, 469 aa, Artificial Sequence
  neuraminidase__InfluenzaA__AFV53230
MNPNQKIITIGSVSLTIATVCFLMQIAILVTTVTLHFKQHECDSPASNQVMPCEPIIIERNITEIVYLNNTTIEKEICPKVVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTKILFIEEGKIVHISPLSGSAQHVEECSCYPRYPDVRCICRDNWKGSNRPVVDISMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINLMPI

SEQ ID NO: 23190 - protein, 469 aa, Artificial Sequence; identical to SEQ ID NO: 16405
  neuraminidase__InfluenzaA__AFV53241

SEQ ID NO: 23191 - protein, 469 aa, Artificial Sequence; identical to SEQ ID NO: 14091
  neuraminidase__InfluenzaA__AFV53252

SEQ ID NO: 23192 - protein, 470 aa, Artificial Sequence
  neuraminidase__InfluenzaA__AFV53263
MNPNQKIITIGSICMAIGTISLILQIGNIISIWISHSIQTGSQNHTGICNQRIITYENNTWVNQTYVNISNTNVVAGKDTTSMILAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITEIIKSWRKQILRTQESECVCVNGSCFTIMTDGPSNRPASYRIFKIEKGKITKSIELDAPNSHYEECSCYPDTGKVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTNTDGNFSVKQDVVAMTDWSGYSGSFVQHPELTGLDCIRPCFWVELIRGRPREETTIWTSGSSISFCGVNSDTVNWSWPDGAELPFTIDK

SEQ ID NO: 23193 - protein, 469 aa, Artificial Sequence
  neuraminidase__InfluenzaA__AFV53274
MNPNQKIITIGSVSLIIATVCFLMQIAILVTTVTLHFKQHECDSPASNQVMPCEPIIIERNITEIVYLNNTTIEKEICPKVVEYRNWSKPQCQITGFAPFSKDNSIRLSAGGDIWVTREPYVSCDPGKCYQFALGQGTTLDNKHSNDTIHDRIPHRTLLMNELGVPFHLGTRQVCVAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRNPNNERGNPGVKGWAFDNGDDVWMGRTISKDLRSGYETFKVIGGWSTPNSKSQINRQVIVDSNNWSGYSGIFSVEGKSCINRCFYVELIRGRQQETRVWWTSNSIVVFCGTSGTYGTGSWPDGANINFMPI

SEQ ID NO: 23194 - protein, 469 aa, Artificial Sequence
  neuraminidase__InfluenzaA__AFV53285
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHIEECSCYPRHPDVRCICRDNWKGSNRPVININMEDYSIDSSYVCSGLVGDTPRNDDSSSNSNCRDPNNERGNPGVKGWAFDNGDDVWMGRTINKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 23195 - protein, 469 aa, Artificial Sequence
  neuraminidase__InfluenzaA__AFV53296
MNPNQKIIIIGSVSLTIATVCFLMQIAILVTTVTLHFKQHECDSPASNQVMPCEPIIIERNITEIVYLNNTTIEKEICPEVVEYRNWSKPQCQITGFAPFSKDNSIRLSAGGDIWVTREPYVSCDPSKCYQFALGQGTTLDNKHSNDTIHDRIPHRTLLMNELGVPFHLGTRQVCVAWSSSSCHDGKAWLHVCVTGDDKNATASFIYDGRLVDSIGSWSQNILRTQESECVCINGTCTVVMTDGSASGRADTRILFIEEGKIVHISPLSGSAQHVEECSCYPRYPDVRCICRDNWKGSNRPVIDINMEDYSIDSSYVCSGLVGDTPRNDDRSSNSNCRDPNNERGNPGVKGWAFDNGDDVWMGRTISKDLRSGYETFKVIGGWSTPNSKSQINRQVIVDSNNWSGYSGIFSVEGKSCINRCFYVELIRGRQQETRVWWTSNSIVVFCGTSGTYGTGSWPDGANINFMPI

SEQ ID NO: 23196 - protein, 469 aa, Artificial Sequence
  neuraminidase__InfluenzaA__AFV53307
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCVTGDDRNATASFIYDGRLVDSIGSWSQNILRTQESECVCINGTCTVVMTDGSASGRADTRILFIKEGKIVHISPLSGSAQHVEECSCYPRYPDVRCICRDNWKGSNRPVIDINMEDYSIDSSYVCSGLVGDTPRNDDSSSNSNCRDPNNERGNPGVKGWAFDNGDDVWMGRTINKDSRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 23197 - protein, 469 aa, Artificial Sequence
  neuraminidase__InfluenzaA__AFV53317
MNPNQKIITIGSVSLTIATVCFLMQIAILATTVTLHFKQHECDSPASNQVMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRSPHRTLLMNELGVPFHLGTKQVCAAWSSSSCHDGKAWLHVCVTGDDRNATASFIYDGRLVDSIGSWSQNILRTQESECVCINGTCTVVMTDGSASGRADTRILFIKEGKIVHIGPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 23198 - protein, 469 aa, Artificial Sequence
  neuraminidase__InfluenzaA__AFV53328
MNPNQKIITIGSVSLTIATVCFLMHIAILATTVTLHFKQHECDSPASNQAMPCEPIIIERNITEIVYLNNTTIEKEICPEVVEYRNWSKPQCQITGFAPFSKDNSIRLSAGGDIWVTREPYVSCDPGKCYQFALGQGTTLDNKHSNGTIHDRIPHRTLLMNELGVPFHLGTKQVCVAWSSSSCHDGKAWLHVCITGDDRNATASFIYDGRLVDSIGSWSQNILRTQESECVCINGTCTVVMTDGSASGRADTRILFIKEGKIVHISPLSGSAQHIEECSCYPRYPDVRCICRDNWKGSNRPVIDINMEDYSIDSSYVCSGLVGDTPRNDDSSSNSNCRDPNNERGNPGVKGWAFDNGDDVWMGRTISKDLRSGYETFKVIGGWSTPNSKSQVNRQVIVDNNNWSGYSGIFSVEGKSCINRCFYVELIRGRPQETRVWWTSNSIVVFCGTSGTYGTGSWPDGANINFMPI

SEQ ID NO: 23199 - protein, 469 aa, Artificial Sequence
  neuraminidase__InfluenzaA__AFV53339
MNPNQKIITIGSASLTIATVCFLMQIAILVTTVTLHFKQHECDSPASNQVMPCEPIIIERNITEIVYLNNTTIEKEICPKVVEYRNWSKPQCKITGFAPFSKDNSIRLSAGGDIWVTREPYVSCDPGKCYQFALGQGTTLDNKHSNDTIHDRIPHRTLLMNELGVPFHLGTRQVCIAWSSSSCHDGKAWLHVCVTGDDKNATASFIYDGRLVDSIGSWSQNILRTQESECVCINGTCTVVMTDGSASGRADTRILFIEEGKIVHMSPLSGSAQHVEECSCYPRYPDVRCICRDNWKGSNRPVVDINMEDYSIDSSYVCSGLVGDTPRNDDRSSNSNCRNPNNEKGNQGVKGWAFDNGDDVWMGRTISKDLRSGYETFKVIGGWSTPNSKSQINRQVIVDSDNRSGYSGIFSVEGKSCINRCFYVELIRGRKQETRVWWTSNSIVVFCGTSGTYGTGSWPDGANINLMPI

SEQ ID NO: 23200 - protein, 469 aa, Artificial Sequence; identical to SEQ ID NO: 16738
  neuraminidase__InfluenzaA__AFX96367

SEQ ID NO: 23201 - protein, 469 aa, Artificial Sequence; identical to SEQ ID NO: 16738
  neuraminidase__InfluenzaA__AFX96386

SEQ ID NO: 23202 - protein, 469 aa, Artificial Sequence; identical to SEQ ID NO: 17092
  neuraminidase__InfluenzaA__AFX96401

SEQ ID NO: 23203 - protein, 469 aa, Artificial Sequence; identical to SEQ ID NO: 17092
  neuraminidase__InfluenzaA__AFX96411

SEQ ID NO: 23204 - protein, 469 aa, Artificial Sequence; identical to SEQ ID NO: 17092
  neuraminidase__InfluenzaA__AFX96421

SEQ ID NO: 23205 - protein, 469 aa, Artificial Sequence; identical to SEQ ID NO: 17092
  neuraminidase__InfluenzaA__AFX96431

SEQ ID NO: 23206 - protein, 469 aa, Artificial Sequence; identical to SEQ ID NO: 17092
  neuraminidase__InfluenzaA__AFX96441

SEQ ID NO: 23207 - protein, 469 aa, Artificial Sequence; identical to SEQ ID NO: 17092
  neuraminidase__InfluenzaA__AFX96451

SEQ ID NO: 23208 - protein, 469 aa, Artificial Sequence; identical to SEQ ID NO: 17092
  neuraminidase__InfluenzaA__AFX96461

SEQ ID NO: 23209 - protein, 469 aa, Artificial Sequence; identical to SEQ ID NO: 16738
  neuraminidase__InfluenzaA__AFX96471

SEQ ID NO: 23210 - protein, 469 aa, Artificial Sequence; identical to SEQ ID NO: 16738
  neuraminidase__InfluenzaA__AFX96481

SEQ ID NO: 23211 - protein, 469 aa, Artificial Sequence; identical to SEQ ID NO: 16738
  neuraminidase__InfluenzaA__AFX96491

SEQ ID NO: 23212 - protein, 469 aa, Artificial Sequence; identical to SEQ ID NO: 16738
  neuraminidase__InfluenzaA__AFX96501

SEQ ID NO: 23213 - protein, 469 aa, Artificial Sequence; identical to SEQ ID NO: 16738
  neuraminidase__InfluenzaA__AFX96511

SEQ ID NO: 23214 - protein, 469 aa, Artificial Sequence
  neuraminidase__InfluenzaA__AFX96521
MNPNQKIITIGSVCMTIGMANLILQIGNIISIWISHSIQLGNQNQIETCNQSVITYENNTWVNQTYVNISNTNFAARQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23215 - protein, 469 aa, Artificial Sequence; identical to SEQ ID NO: 16738
  neuraminidase__InfluenzaA__AFX96531

SEQ ID NO: 23216 - protein, 469 aa, Artificial Sequence; identical to SEQ ID NO: 16738
  neuraminidase__InfluenzaA__AFX96541

SEQ ID NO: 23217 - protein, 469 aa, Artificial Sequence; identical to SEQ ID NO: 16738
  neuraminidase__InfluenzaA__AFX96551

SEQ ID NO: 23218 - protein, 469 aa, Artificial Sequence; identical to SEQ ID NO: 21262
  neuraminidase__InfluenzaA__AFX96561

SEQ ID NO: 23219 - protein, 469 aa, Artificial Sequence; identical to SEQ ID NO: 16738
  neuraminidase__InfluenzaA__AFX96571

SEQ ID NO: 23220 - protein, 469 aa, Artificial Sequence; identical to SEQ ID NO: 16738
  neuraminidase__InfluenzaA__AFX96581

SEQ ID NO: 23221 - protein, 469 aa, Artificial Sequence; identical to SEQ ID NO: 16738
  neuraminidase__InfluenzaA__AFX96591

SEQ ID NO: 23222 - protein, 469 aa, Artificial Sequence; identical to SEQ ID NO: 16738
  neuraminidase__InfluenzaA__AFX96601

SEQ ID NO: 23223 - protein, 469 aa, Artificial Sequence; identical to SEQ ID NO: 16738
  neuraminidase__InfluenzaA__AFX96611

SEQ ID NO: 23224 - protein, 469 aa, Artificial Sequence; identical to SEQ ID NO: 16738
  neuraminidase__InfluenzaA__AFX96621

SEQ ID NO: 23225 - protein, 469 aa, Artificial Sequence; identical to SEQ ID NO: 16738
  neuraminidase__InfluenzaA__AFX96631

SEQ ID NO: 23226 - protein, 469 aa, Artificial Sequence
  neuraminidase__InfluenzaA__AFX96641
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSKFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23227 - protein, 469 aa, Artificial Sequence; identical to SEQ ID NO: 16738
  neuraminidase__InfluenzaA__AFX96651

SEQ ID NO: 23228 - protein, 469 aa, Artificial Sequence; identical to SEQ ID NO: 16738
  neuraminidase__InfluenzaA__AFX96661

SEQ ID NO: 23229 - protein, 469 aa, Artificial Sequence; identical to SEQ ID NO: 16738
  neuraminidase__InfluenzaA__AFX96671

SEQ ID NO: 23230 - protein, 469 aa, Artificial Sequence; identical to SEQ ID NO: 16738
  neuraminidase__InfluenzaA__AFX96681

SEQ ID NO: 23231 - protein, 469 aa, Artificial Sequence; identical to SEQ ID NO: 16738
  neuraminidase__InfluenzaA__AFX96691

SEQ ID NO: 23232 - protein, 469 aa, Artificial Sequence
  neuraminidase__InfluenzaA__AFX96701
MNPNQKIITIGSVCMTIGMANLILQIGNIISIWISHSIQLGNQNQIETCNQSIITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSFNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSIISFCGVNSDTVGWSWPDGAELPFTIDK

SEQ ID NO: 23233 - protein, 469 aa, Artificial Sequence; identical to SEQ ID NO: 16738
  neuraminidase__InfluenzaA__AFX96711

SEQ ID NO: 23234 - protein, 469 aa, Artificial Sequence
  neuraminidase__InfluenzaA__AFX96721
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTVWTSGSSISFCGVNSDTVGWSWPDGAELPFTIDK

SEQ ID NO: 23235 - protein, 469 aa, Artificial Sequence; identical to SEQ ID NO: 23234
  neuraminidase__InfluenzaA__AFX96731

SEQ ID NO: 23236 - protein, 469 aa, Artificial Sequence; identical to SEQ ID NO: 16738
  neuraminidase__InfluenzaA__AFX96741

SEQ ID NO: 23237 - protein, 469 aa, Artificial Sequence; identical to SEQ ID NO: 16738
  neuraminidase__InfluenzaA__AFX96751

SEQ ID NO: 23238 - protein, 469 aa, Artificial Sequence; identical to SEQ ID NO: 17756
  neuraminidase__InfluenzaA__AFX96761

SEQ ID NO: 23239 - protein, 469 aa, Artificial Sequence; identical to SEQ ID NO: 16738
  neuraminidase__InfluenzaA__AFX96771

SEQ ID NO: 23240 - protein, 469 aa, Artificial Sequence
  neuraminidase__InfluenzaA__AFX96791
MNPNQKIITIGSVCMTIGMANLILQVGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACINGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23241 - protein, 469 aa, Artificial Sequence; identical to SEQ ID NO: 23240
  neuraminidase__InfluenzaA__AFX96801

SEQ ID NO: 23242 - protein, 469 aa, Artificial Sequence
  neuraminidase__InfluenzaA__AFX96811
MNPNQKIITIGSVCMTIGMANLILQIGNIISIWISHSIQLGNQNQIETCNQSVITYENNTWVNQTYVNISNTNFAAGQSVVSVRLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23243 - protein, 469 aa, Artificial Sequence; identical to SEQ ID NO: 16738
  neuraminidase__InfluenzaA__AFX96821

SEQ ID NO: 23244 - protein, 469 aa, Artificial Sequence; identical to SEQ ID NO: 23240
  neuraminidase__InfluenzaA__AFX96831

SEQ ID NO: 23245 - protein, 469 aa, Artificial Sequence
  neuraminidase__InfluenzaA__AFX96841
MNPNQKIITIGSVCMTIGMANLILQIGNIISIWISHSIQLGNQNQIETCNQSVITYENNTWVNQTYVNISNTNFAAGQSVVSVRLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYYYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23246 - protein, 469 aa, Artificial Sequence; identical to SEQ ID NO: 16738
  neuraminidase__InfluenzaA__AFX96859

SEQ ID NO: 23247 - protein, 469 aa, Artificial Sequence; identical to SEQ ID NO: 16738
  neuraminidase__InfluenzaA__AFX96907

SEQ ID NO: 23248 - protein, 469 aa, Artificial Sequence; identical to SEQ ID NO: 16738
  neuraminidase__InfluenzaA__AFX96917

SEQ ID NO: 23249 - protein, 469 aa, Artificial Sequence; identical to SEQ ID NO: 16738
  neuraminidase__InfluenzaA__AFX96927

SEQ ID NO: 23250 - protein, 469 aa, Artificial Sequence
  neuraminidase__InfluenzaA__AFX96937
MNPNQKIITIGSVCMTIGMANLILQIGNIISIWISHSIQLGNQNQIETCNQSVITYENNTWVNQTYVNISSTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23251 - protein, 469 aa, Artificial Sequence; identical to SEQ ID NO: 16728
  neuraminidase__InfluenzaA__AFY23991

SEQ ID NO: 23252 - protein, 469 aa, Artificial Sequence; identical to SEQ ID NO: 16738
  neuraminidase__InfluenzaA__AFY24001

SEQ ID NO: 23253 - protein, 469 aa, Artificial Sequence; identical to SEQ ID NO: 16738
  neuraminidase__InfluenzaA__AFY24022

SEQ ID NO: 23254 - protein, 469 aa, Artificial Sequence; identical to SEQ ID NO: 16738
  neuraminidase__InfluenzaA__AFY24043

SEQ ID NO: 23255 - protein, 469 aa, Artificial Sequence
  neuraminidase__InfluenzaA__AFY24153
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINITDYSIVSSYVCSGLVGDTPRKNDSSSSSHCLDPNNEEGGHGVKGWAFDDGNDVWMGRTISEKLRSGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 23256 - protein, 469 aa, Artificial Sequence
  neuraminidase__InfluenzaA__AFY24208
MNPNQKIITIGSVSLTISTICFFMQIAILITTVTLHFKQYEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNDTVHNRTPYRTLLMNELGVPFHLGTKQVCIAWSSSSCHDGKAWLHVCVTGDDENATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLDPNNEEGGHGVKGWAFDDGNDVWMGRTISERLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 23257 - protein, 469 aa, Artificial Sequence; identical to SEQ ID NO: 15929
  neuraminidase__InfluenzaA__AFY24219

SEQ ID NO: 23258 - protein, 469 aa, Artificial Sequence
  neuraminidase__InfluenzaA__AGB12978
MNPNQRIITIGSVCMTIGMANLILQIGNIISIWISHSIQLGNQNQIETCNQSVITYENNTWVNQTYVNISNTNFAARQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23259 - protein, 469 aa, Artificial Sequence; identical to SEQ ID NO: 20257
  neuraminidase__InfluenzaA__AGB12989

SEQ ID NO: 23260 - protein, 469 aa, Artificial Sequence; identical to SEQ ID NO: 20709
  neuraminidase__InfluenzaA__AGB13009

SEQ ID NO: 23261 - protein, 469 aa, Artificial Sequence; identical to SEQ ID NO: 20709
  neuraminidase__InfluenzaA__AGB13019

SEQ ID NO: 23262 - protein, 469 aa, Artificial Sequence; identical to SEQ ID NO: 20709
  neuraminidase__InfluenzaA__AGB13029

SEQ ID NO: 23263 - protein, 469 aa, Artificial Sequence; identical to SEQ ID NO: 20958
  neuraminidase__InfluenzaA__AGB13039

SEQ ID NO: 23264 - protein, 469 aa, Artificial Sequence; identical to SEQ ID NO: 20709
  neuraminidase__InfluenzaA__AGB13051

SEQ ID NO: 23265 - protein, 469 aa, Artificial Sequence
  neuraminidase__InfluenzaA__AGB13069
MNPNQKIITIGSICMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWISFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23266 - protein, 469 aa, Artificial Sequence
  neuraminidase__InfluenzaA__AGB13074
MNPNQKIITIGSVCMTIGMANLILQIGNIISIWISHSIQLGNQNQIETCNQSVITYENNTWVNQTYVNISNTNFAAGQSVASVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23267 - protein, 469 aa, Artificial Sequence
  neuraminidase__InfluenzaA__AGB13115
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVLREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWRGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23268 - protein, 469 aa, Artificial Sequence; identical to SEQ ID NO: 20709
  neuraminidase__InfluenzaA__AGB13133

SEQ ID NO: 23269 - protein, 469 aa, Artificial Sequence; identical to SEQ ID NO: 20257
  neuraminidase__InfluenzaA__AGB13152

SEQ ID NO: 23270 - protein, 469 aa, Artificial Sequence; identical to SEQ ID NO: 20257
  neuraminidase__InfluenzaA__AGB13162

SEQ ID NO: 23271 - protein, 469 aa, Artificial Sequence; identical to SEQ ID NO: 21080
  neuraminidase__InfluenzaA__AGB13173

SEQ ID NO: 23272 - protein, 469 aa, Artificial Sequence
  neuraminidase__InfluenzaA__AGB13183
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGQDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23273 - protein, 469 aa, Artificial Sequence; identical to SEQ ID NO: 20709
  neuraminidase__InfluenzaA__AGB13193

SEQ ID NO: 23274 - protein, 469 aa, Artificial Sequence; identical to SEQ ID NO: 20776
  neuraminidase__InfluenzaA__AGB13203

SEQ ID NO: 23275 - protein, 469 aa, Artificial Sequence; identical to SEQ ID NO: 20709
  neuraminidase__InfluenzaA__AGB13213

SEQ ID NO: 23276 - protein, 469 aa, Artificial Sequence; identical to SEQ ID NO: 20709
  neuraminidase__InfluenzaA__AGB13223

SEQ ID NO: 23277 - protein, 469 aa, Artificial Sequence; identical to SEQ ID NO: 20709
  neuraminidase__InfluenzaA__AGB13233

SEQ ID NO: 23278 - protein, 469 aa, Artificial Sequence
  neuraminidase__InfluenzaA__AGB13243
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIERGKIVKSVEMNAPNYYYEECSCYPDSSEITCVCRDNWHGSNRPWVSFNQNLEYQIGYICSGVFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23279 - protein, 469 aa, Artificial Sequence; identical to SEQ ID NO: 20776
  neuraminidase__InfluenzaA__AGB13253

SEQ ID NO: 23280 - protein, 469 aa, Artificial Sequence
  neuraminidase__InfluenzaA__AGB13263
MNPNQKIITIGSVCMTIGMANLILQIGNIISIWISHSIQLGNQNQTETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMKAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTVDK

SEQ ID NO: 23281 - protein, 469 aa, Artificial Sequence; identical to SEQ ID NO: 20709
  neuraminidase__InfluenzaA__AGB13273

SEQ ID NO: 23282 - protein, 469 aa, Artificial Sequence
  neuraminidase__InfluenzaA__AGB13283
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRRGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23283 - protein, 469 aa, Artificial Sequence; identical to SEQ ID NO: 20709
  neuraminidase__InfluenzaA__AGB13293

SEQ ID NO: 23284 - protein, 469 aa, Artificial Sequence; identical to SEQ ID NO: 20709
  neuraminidase__InfluenzaA__AGB13303

SEQ ID NO: 23285 - protein, 469 aa, Artificial Sequence
  neuraminidase__InfluenzaA__AGB13313
MNPNQKIITIGSVCMTIGMANLILQIGNIISIWISHSIQLGNQNQIETCNQSVITYENNTWVNQTYVNISNTNFAAGQSVVSAKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKKGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23286 - protein, 469 aa, Artificial Sequence; identical to SEQ ID NO: 20709
  neuraminidase__InfluenzaA__AGB13323

SEQ ID NO: 23287 - protein, 469 aa, Artificial Sequence
  neuraminidase__InfluenzaA__AGB13333
MNPNQKIITIGSVCMTIGMANLILQIGNIISIWISHSIQLGNQSQIETCNQSVITYENNTWVNQTYVNISNTNFAAGQSAVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23288 - protein, 469 aa, Artificial Sequence; identical to SEQ ID NO: 20709
  neuraminidase__InfluenzaA__AGB13343

SEQ ID NO: 23289 - protein, 469 aa, Artificial Sequence; identical to SEQ ID NO: 20958
  neuraminidase__InfluenzaA__AGB13353

SEQ ID NO: 23290 - protein, 469 aa, Artificial Sequence
  neuraminidase__InfluenzaA__AGB13363
MNPNQKIITIGSVCMTIGMANLILQIGNIISIWISHSIQLGNQNQIETCNQSVITYENNTWVNQTYVNISNTNFAAGQSVASVKLAGNSSLCSVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23291 - protein, 469 aa, Artificial Sequence
  neuraminidase__InfluenzaA__AGB13383
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGSGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23292 - protein, 469 aa, Artificial Sequence; identical to SEQ ID NO: 20257
  neuraminidase__InfluenzaA__AGB13393

SEQ ID NO: 23293 - protein, 469 aa, Artificial Sequence; identical to SEQ ID NO: 20957
  neuraminidase__InfluenzaA__AGB13403

SEQ ID NO: 23294 - protein, 469 aa, Artificial Sequence; identical to SEQ ID NO: 20257
  neuraminidase__InfluenzaA__AGB13413

SEQ ID NO: 23295 - protein, 469 aa, Artificial Sequence; identical to SEQ ID NO: 20257
  neuraminidase__InfluenzaA__AGB13423

SEQ ID NO: 23296 - protein, 469 aa, Artificial Sequence; identical to SEQ ID NO: 20957
  neuraminidase__InfluenzaA__AGB13433

SEQ ID NO: 23297 - protein, 469 aa, Artificial Sequence; identical to SEQ ID NO: 20957
  neuraminidase__InfluenzaA__AGB13443

SEQ ID NO: 23298 - protein, 469 aa, Artificial Sequence
  neuraminidase__InfluenzaA__AGB13453
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSFSSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23299 - protein, 469 aa, Artificial Sequence; identical to SEQ ID NO: 20257
  neuraminidase__InfluenzaA__AGB13463

SEQ ID NO: 23300 - protein, 469 aa, Artificial Sequence; identical to SEQ ID NO: 20709
  neuraminidase__InfluenzaA__AGB13473

SEQ ID NO: 23301 - protein, 469 aa, Artificial Sequence
  neuraminidase__InfluenzaA__AGB13483
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGQPKENTIWTSGSSISFCGVNSDTVGWSWPDGAELPFTIDK

SEQ ID NO: 23302 - protein, 469 aa, Artificial Sequence; identical to SEQ ID NO: 20994
  neuraminidase__InfluenzaA__AGB13493

SEQ ID NO: 23303 - protein, 469 aa, Artificial Sequence; identical to SEQ ID NO: 20786
  neuraminidase__InfluenzaA__AGB13503

SEQ ID NO: 23304 - protein, 469 aa, Artificial Sequence; identical to SEQ ID NO: 18200
  neuraminidase__InfluenzaA__AGB13513

SEQ ID NO: 23305 - protein, 469 aa, Artificial Sequence; identical to SEQ ID NO: 20992
  neuraminidase__InfluenzaA__AGB13523

SEQ ID NO: 23306 - protein, 469 aa, Artificial Sequence; identical to SEQ ID NO: 20992
  neuraminidase__InfluenzaA__AGB13533

SEQ ID NO: 23307 - protein, 469 aa, Artificial Sequence; identical to SEQ ID NO: 20709
  neuraminidase__InfluenzaA__AGB13543

SEQ ID NO: 23308 - protein, 469 aa, Artificial Sequence; identical to SEQ ID NO: 20709
  neuraminidase__InfluenzaA__AGB13553

SEQ ID NO: 23309 - protein, 469 aa, Artificial Sequence
  neuraminidase__InfluenzaA__AGB13563
MNPNQKIITIGSVCMTIGVANLILQIGNIISIWISHSIQLGNQNQIETCNQSVITYENNTWVNQTYVNISNTNFAAGQSVVSVNLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKNISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23310 - protein, 469 aa, Artificial Sequence; identical to SEQ ID NO: 20709
  neuraminidase__InfluenzaA__AGB13573

SEQ ID NO: 23311 - protein, 469 aa, Artificial Sequence
  neuraminidase__InfluenzaA__AGB13583
MNPNQKIITIGSVCMTIGMANLILQIGNIISIWISHSIQLGNQNQIETCNQSVITYENNTWVNQTYVNISNTNFAAGQSVGSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23312 - protein, 469 aa, Artificial Sequence; identical to SEQ ID NO: 20709
  neuraminidase__InfluenzaA__AGB13593

SEQ ID NO: 23313 - protein, 469 aa, Artificial Sequence; identical to SEQ ID NO: 20709
  neuraminidase__InfluenzaA__AGB13603

SEQ ID NO: 23314 - protein, 469 aa, Artificial Sequence; identical to SEQ ID NO: 20709
  neuraminidase__InfluenzaA__AGB13613

SEQ ID NO: 23315 - protein, 469 aa, Artificial Sequence; identical to SEQ ID NO: 20709
  neuraminidase__InfluenzaA__AGB13623

SEQ ID NO: 23316 - protein, 469 aa, Artificial Sequence
  neuraminidase__InfluenzaA__AGB13633
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSIISFCGVNSDTVGWSWPDGAELPFTIDK

SEQ ID NO: 23317 - protein, 469 aa, Artificial Sequence
  neuraminidase__InfluenzaA__AGB13643
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNGIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECVCVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSVKQDIIGINEWSGYSGSFVQHPELTGLDCIRPCFWVELIRGRPKENTIWTSGSSISFCGVNSDTVGWSWPDGAELPFTIDK

SEQ ID NO: 23318 - protein, 469 aa, Artificial Sequence
  neuraminidase__InfluenzaA__AGB13653
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECVCVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSVKQDIIGINEWSGYSGSFVQHPELTGLDCIRPCFWVELIRGRPKENTIWTSGSSISFCGVNSDTVGWSWPDGAELPFTIDK

SEQ ID NO: 23319 - protein, 469 aa, Artificial Sequence; identical to SEQ ID NO: 20257
  neuraminidase__InfluenzaA__AGB13663

SEQ ID NO: 23320 - protein, 469 aa, Artificial Sequence; identical to SEQ ID NO: 20257
  neuraminidase__InfluenzaA__AGB13724

SEQ ID NO: 23321 - protein, 469 aa, Artificial Sequence; identical to SEQ ID NO: 20709
  neuraminidase__InfluenzaA__AGB13734

SEQ ID NO: 23322 - protein, 469 aa, Artificial Sequence; identical to SEQ ID NO: 17214
  neuraminidase__InfluenzaA__AGB51359

SEQ ID NO: 23323 - protein, 469 aa, Artificial Sequence
  neuraminidase__InfluenzaA__AGB97270
MNPNQKIITIGSVCMTIGMANLILQIGNIISIWISHSIQLRNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAMAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23324 - protein, 469 aa, Artificial Sequence
  neuraminidase__InfluenzaA__AGB97274
MNPNQKIITIGSVCMTIGMANLILQIGNIISIWISHSIQLRNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23325 - protein, 469 aa, Artificial Sequence; identical to SEQ ID NO: 22146
  neuraminidase__InfluenzaA__AGB97289

SEQ ID NO: 23326 - protein, 469 aa, Artificial Sequence
  neuraminidase__InfluenzaA__AGE15475
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGSLLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNYFSIKQDIVGINEWSGYSGSFVQHPELTGLDCIRPCFWVELIRGRPKENTIWTSGSSISFCGVNSDTVGWSWPDGAELPFSIDK

SEQ ID NO: 23327 - protein, 469 aa, Artificial Sequence
  neuraminidase__InfluenzaA__AGE15476
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGSLLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNYFSIKQDIVGINEWSGYSGSFVQHPELTGLDCIRPCFWVELIRGRPKENTIWTSGSSISFCGVNSDTVGWSWPDGAELPFTIDK

SEQ ID NO: 23328 - protein, 469 aa, Artificial Sequence; identical to SEQ ID NO: 23158
  neuraminidase__InfluenzaA__AGE15477

SEQ ID NO: 23329 - protein, 469 aa, Artificial Sequence
  neuraminidase__InfluenzaA__AGE15478
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGSLLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNYFSIKQDIVGINEWSGYSGSFVQHPELTGLDCIRPCFWVELIRGRPKENTIWTSGSSISFCGVKSDTVGWSWPDGAELPFTIDK

SEQ ID NO: 23330 - protein, 469 aa, Artificial Sequence
  neuraminidase__InfluenzaA__AGE15479
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGSLLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPIDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNYFSIKQDIVGINEWSGYSGSFVQHPELTGLDCIRPCFWVELIRGRPKENTIWTSGSSISFCGVNSDTVGWSWPDGAELPFTIDK

SEQ ID NO: 23331 - protein, 469 aa, Artificial Sequence; identical to SEQ ID NO: 23158
  neuraminidase__InfluenzaA__AGE15480

SEQ ID NO: 23332 - protein, 469 aa, Artificial Sequence; identical to SEQ ID NO: 18200
  neuraminidase__InfluenzaA__AGE89270

SEQ ID NO: 23333 - protein, 469 aa, Artificial Sequence; identical to SEQ ID NO: 18200
  neuraminidase__InfluenzaA__AGE89280

SEQ ID NO: 23334 - protein, 469 aa, Artificial Sequence
  neuraminidase__InfluenzaA__AGE89290
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCIVVMTDGSASGKADTKILFVEEGKIVHTSTLSGSAQHVEECSCYPRYPGVRCVCRDNWKGSNRPIVDINIKDHSIISSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23335 - protein, 469 aa, Artificial Sequence; identical to SEQ ID NO: 20257
  neuraminidase__InfluenzaA__AGE89301

SEQ ID NO: 23336 - protein, 469 aa, Artificial Sequence
  neuraminidase__InfluenzaA__AGE89311
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWKNNILRTQESECACVNGSCFTVMTDGPSDGQASYKIFRIEKGKIVKSVEMNAPNYHYEECSCYPDSSEITCVCRDNWHGSNRPWVSFNQNLEYRIGYICSGIFGDNPRPNDKTGSCGPVSSNGANGVKGFSFKYGNGVWIGRTKSISSRNGFEMIWDPNGWTGTDNNFSKKQDIIGINEWSGYSGSFVQHPELTGLDCIRPCFWVELIRGRPKENTIWTSGSSMSFCGVNSDTVGWSWPDGAELPFTIDK

SEQ ID NO: 23337 - protein, 469 aa, Artificial Sequence; identical to SEQ ID NO: 21787
  neuraminidase__InfluenzaA__AGE89321

SEQ ID NO: 23338 - protein, 469 aa, Artificial Sequence; identical to SEQ ID NO: 21143
  neuraminidase__InfluenzaA__AGE89332

SEQ ID NO: 23339 - protein, 469 aa, Artificial Sequence; identical to SEQ ID NO: 20257
  neuraminidase__InfluenzaA__AGE89343

SEQ ID NO: 23340 - protein, 469 aa, Artificial Sequence
  neuraminidase__InfluenzaA__AGE89353
MNPNQKIITIGSVSLTISTICFFMQIAILITTVTLHFKQYEFNSPPNNQVMLCEPTIIERNITEIVYLTNITIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKGNRSGYSGIFSVEGKSCINRCFYVELIRGRKEETEVLWTSNSIVVFCGTSGTYGTGSWPDGADLNLMPI

SEQ ID NO: 23341 - protein, 469 aa, Artificial Sequence; identical to SEQ ID NO: 20994
  neuraminidase__InfluenzaA__AGE89364

SEQ ID NO: 23342 - protein, 469 aa, Artificial Sequence; identical to SEQ ID NO: 21787
  neuraminidase__InfluenzaA__AGE89374

SEQ ID NO: 23343 - protein, 469 aa, Artificial Sequence
  neuraminidase__InfluenzaA__AGE89385
MNPNQKIITIGSVCMTIGMANLILQIGNIISIWISHSIQLGNQNQIETCNQSVITYENNTWVNQTYVNISNTNFAAGQSVASVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23344 - protein, 469 aa, Artificial Sequence
  neuraminidase__InfluenzaA__AGE89395
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23345 - protein, 469 aa, Artificial Sequence; identical to SEQ ID NO: 18200
  neuraminidase__InfluenzaA__AGE89425

SEQ ID NO: 23346 - protein, 469 aa, Artificial Sequence; identical to SEQ ID NO: 19518
  neuraminidase__InfluenzaA__AGE89722

SEQ ID NO: 23347 - protein, 469 aa, Artificial Sequence
  neuraminidase__InfluenzaA__AGE89733
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPNDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23348 - protein, 469 aa, Artificial Sequence
  neuraminidase__InfluenzaA__AGE89743
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDKDNRSGYSGIFSVEGKSCINRCFYVELIRGRKEETEVLWTSNSIVVFCGTSGTYGTGSWPDGADLNLMPI

SEQ ID NO: 23349 - protein, 469 aa, Artificial Sequence; identical to SEQ ID NO: 21787
  neuraminidase__InfluenzaA__AGE89754

SEQ ID NO: 23350 - protein, 469 aa, Artificial Sequence; identical to SEQ ID NO: 21787
  neuraminidase__InfluenzaA__AGE89765

SEQ ID NO: 23351 - protein, 469 aa, Artificial Sequence
  neuraminidase__InfluenzaA__AGG13414
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNSVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLQINKQVIVDRGDRSGYSGIFSVEGKSCINRCFYVELIRGRKEETEVLWTSNSIVVFCGTSGTYGTGSWPDGADLNLMPI

SEQ ID NO: 23352 - protein, 469 aa, Artificial Sequence; identical to SEQ ID NO: 22146
  neuraminidase__InfluenzaA__AGG13426

SEQ ID NO: 23353 - protein, 469 aa, Artificial Sequence; identical to SEQ ID NO: 22146
  neuraminidase__InfluenzaA__AGG13438

SEQ ID NO: 23354 - protein, 469 aa, Artificial Sequence
  neuraminidase__InfluenzaA__AGG13498
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCAVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTINETSRLGYETFKVIEGWSNPKSKLQINRQVIVDRGNRSGYSGIFSVEGKNCINRCFYVELIRGRKEETEVLWTSNSIVVFCGTSGTYGTGSWPDGADLNLMPI

SEQ ID NO: 23355 - protein, 469 aa, Artificial Sequence; identical to SEQ ID NO: 22146
  neuraminidase__InfluenzaA__AGG13510

SEQ ID NO: 23356 - protein, 469 aa, Artificial Sequence; identical to SEQ ID NO: 23354
  neuraminidase__InfluenzaA__AGG13522

SEQ ID NO: 23357 - protein, 469 aa, Artificial Sequence
  neuraminidase__InfluenzaA__AGG13534
MNPNQKIITIGSVSLTISTVCFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23358 - protein, 469 aa, Artificial Sequence
  neuraminidase__InfluenzaA__AGG13546
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWRGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRSDRSGYSGIFSVEGKSCINRCFYVELIRGRKEETEVLWTSNSIVVFCGTSGTYGTGSWPDGADLNLMPI

SEQ ID NO: 23359 - protein, 469 aa, Artificial Sequence; identical to SEQ ID NO: 22146
  neuraminidase__InfluenzaA__AGG13558

SEQ ID NO: 23360 - protein, 469 aa, Artificial Sequence; identical to SEQ ID NO: 22146
  neuraminidase__InfluenzaA__AGG13570

SEQ ID NO: 23361 - protein, 469 aa, Artificial Sequence
  neuraminidase__InfluenzaA__AGG13582
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGEDKNATASFIYNGRLVDSVVSWSKETLRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23362 - protein, 469 aa, Artificial Sequence; identical to SEQ ID NO: 22146
  neuraminidase__InfluenzaA__AGG13606

SEQ ID NO: 23363 - protein, 469 aa, Artificial Sequence
  neuraminidase__InfluenzaA__AGG13618
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYLCSGLVGDTPRKNDGSSSSHCLDPNNEEGGHGVKGWAFDDGNDVWMGRTINETSRLGYETFKVIEGWSNPKSKLQINRQIIVDRGDRSGYSGIFSVEGKSCINRCFYVELIRGRKEETEVLWTSNSIVVFCGTSGTYGTGSWPDGADLNLMPI

SEQ ID NO: 23364 - protein, 469 aa, Artificial Sequence
  neuraminidase__InfluenzaA__AGG13630
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGEDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23365 - protein, 469 aa, Artificial Sequence; identical to SEQ ID NO: 22146
  neuraminidase__InfluenzaA__AGG13642

SEQ ID NO: 23366 - protein, 469 aa, Artificial Sequence
  neuraminidase__InfluenzaA__AGG13654
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCAVVMTDGSASGKADTKILFIEEGKIVQTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTINETSRLGYETFKVIEGWSNPKSKLQINRQVIVDRGNRSGYSGIFSVEGKNCINRCFYVELIRGRKEEIEVLWTSNSIVVFCGTSGTYGTGSWPDGADLNLMPI

SEQ ID NO: 23367 - protein, 469 aa, Artificial Sequence; identical to SEQ ID NO: 23357
  neuraminidase__InfluenzaA__AGG13666

SEQ ID NO: 23368 - protein, 469 aa, Artificial Sequence
  neuraminidase__InfluenzaA__AGG13678
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPLSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLGPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTAGTYGTGSWPDGADLNLMPI

SEQ ID NO: 23369 - protein, 469 aa, Artificial Sequence; identical to SEQ ID NO: 22146
  neuraminidase__InfluenzaA__AGG13690

SEQ ID NO: 23370 - protein, 469 aa, Artificial Sequence
  neuraminidase__InfluenzaA__AGG13702
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGNAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23371 - protein, 469 aa, Artificial Sequence; identical to SEQ ID NO: 23354
  neuraminidase__InfluenzaA__AGG13714

SEQ ID NO: 23372 - protein, 469 aa, Artificial Sequence; identical to SEQ ID NO: 22146
  neuraminidase__InfluenzaA__AGG13726

SEQ ID NO: 23373 - protein, 469 aa, Artificial Sequence; identical to SEQ ID NO: 22146
  neuraminidase__InfluenzaA__AGG13738

SEQ ID NO: 23374 - protein, 469 aa, Artificial Sequence; identical to SEQ ID NO: 22146
  neuraminidase__InfluenzaA__AGG13750

SEQ ID NO: 23375 - protein, 469 aa, Artificial Sequence
  neuraminidase__InfluenzaA__AGG13762
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23376 - protein, 469 aa, Artificial Sequence
  neuraminidase__InfluenzaA__AGG13774
MNPNQKIITIGSVSLTISTICFFMQIAILITTVTLHFKQYEFNSPPNNQVMLCEPTTIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCAVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTINETSRLGYETFKVIEGWSNPKSKLQINRQVIVDRGNRSGYSGIFSVEGKNCINRCFYVELIRGRKEETEVLWTSNSIVVFCGTSGTYGTGSWPDGADLNLMPI

SEQ ID NO: 23377 - protein, 469 aa, Artificial Sequence
  neuraminidase__InfluenzaA__AGG13786
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNLHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23378 - protein, 469 aa, Artificial Sequence; identical to SEQ ID NO: 23354
  neuraminidase__InfluenzaA__AGG13798

SEQ ID NO: 23379 - protein, 469 aa, Artificial Sequence
  neuraminidase__InfluenzaA__AGG13810
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSRYVCSGLVGDTPRKNDSSSSSHCLGPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23380 - protein, 469 aa, Artificial Sequence; identical to SEQ ID NO: 23354
  neuraminidase__InfluenzaA__AGG13822

SEQ ID NO: 23381 - protein, 469 aa, Artificial Sequence; identical to SEQ ID NO: 23354
  neuraminidase__InfluenzaA__AGG13834

SEQ ID NO: 23382 - protein, 469 aa, Artificial Sequence; identical to SEQ ID NO: 23375
  neuraminidase__InfluenzaA__AGG13846

SEQ ID NO: 23383 - protein, 469 aa, Artificial Sequence; identical to SEQ ID NO: 22146
  neuraminidase__InfluenzaA__AGG13858

SEQ ID NO: 23384 - protein, 469 aa, Artificial Sequence
  neuraminidase__InfluenzaA__AGG13870
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDRCYQFALGQGTTLNNMHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGTSCINRCFYVELIRGRKEETEVLWTSNSIVVFCGTSGTYGTGSWPDGADLNLMPI

SEQ ID NO: 23385 - protein, 469 aa, Artificial Sequence
  neuraminidase__InfluenzaA__AGG13894
MNPNQKIITIGSVSLTISTVCFFMQIAILITTVTLHFKQYEFNSPPNNQVMLCEPTIIERNVTEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23386 - protein, 469 aa, Artificial Sequence; identical to SEQ ID NO: 23354
  neuraminidase__InfluenzaA__AGG13906

SEQ ID NO: 23387 - protein, 469 aa, Artificial Sequence
  neuraminidase__InfluenzaA__AGG13930
MNPNQKIITIGSVSLTISTICFFMQIAILITTVTLHFKQYEFNSPPNNQVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDRSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23388 - protein, 469 aa, Artificial Sequence; identical to SEQ ID NO: 23364
  neuraminidase__InfluenzaA__AGG13942

SEQ ID NO: 23389 - protein, 469 aa, Artificial Sequence
  neuraminidase__InfluenzaA__AGG13965
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23390 - protein, 469 aa, Artificial Sequence; identical to SEQ ID NO: 23357
  neuraminidase__InfluenzaA__AGG13976

SEQ ID NO: 23391 - protein, 469 aa, Artificial Sequence; identical to SEQ ID NO: 23357
  neuraminidase__InfluenzaA__AGG13988

SEQ ID NO: 23392 - protein, 469 aa, Artificial Sequence; identical to SEQ ID NO: 23357
  neuraminidase__InfluenzaA__AGG14000

SEQ ID NO: 23393 - protein, 469 aa, Artificial Sequence; identical to SEQ ID NO: 23357
  neuraminidase__InfluenzaA__AGG14012

SEQ ID NO: 23394 - protein, 469 aa, Artificial Sequence; identical to SEQ ID NO: 23375
  neuraminidase__InfluenzaA__AGG14024

SEQ ID NO: 23395 - protein, 469 aa, Artificial Sequence
  neuraminidase__InfluenzaA__AGG14036
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCAVVMTDGSASGKADTKILFIEEGKIVHTSTLSGSAQHVEECSCYPRYPGVRCVCRDNWKGSNRPIVDINIKDHSIVSSYMCSGLVGDTPRKNDSSSSGHCLDPNNEEGGHGVKGWAFDDGNDVWMGRTINETSRLGYETFKVIEGWSNPKSKLQINRQVIVDRGNRSGYSGIFSVEGKNCINRCFYVELIRGRKEETEVLWTSNSIVVFCGTSGTYGTGSWPDGADLNLMPI

SEQ ID NO: 23396 - protein, 469 aa, Artificial Sequence; identical to SEQ ID NO: 23375
  neuraminidase__InfluenzaA__AGG14321

SEQ ID NO: 23397 - protein, 469 aa, Artificial Sequence; identical to SEQ ID NO: 22146
  neuraminidase__InfluenzaA__AGG14333

SEQ ID NO: 23398 - protein, 469 aa, Artificial Sequence; identical to SEQ ID NO: 21787
  neuraminidase__InfluenzaA__AGG84182

SEQ ID NO: 23399 - protein, 465 aa, Artificial Sequence
  neuraminidase__InfluenzaA__AGJ51955
MNPNQKILCTSATAIIIGAIAVLIGIANLGLNIGLHLKPGCNCSHSQPETTNTSQTIINNYYNETNITNIQMEERTSRNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVLWTGDSIVSMCSSTEFLGQWNWPDGAKIEYFL

SEQ ID NO: 23400 - protein, 465 aa, Artificial Sequence
  neuraminidase__InfluenzaA__AGJ72863
MNPNQKILCTSATAIIIGAIAVLIGIANLGLNIGLHLKPGCNCSHSQPETTNTSQTIINNYYNETNITNIQMEERTSRNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVEVIRGRPKEDKVWWAGNSIVSMCSSTEFLGQWNWPDGAKIEYFL

SEQ ID NO: 23401 - protein, 469 aa, Artificial Sequence
  neuraminidase__InfluenzaA__AGJ73328
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWNGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23402 - protein, 469 aa, Artificial Sequence; identical to SEQ ID NO: 20257
  neuraminidase__InfluenzaA__AGJ73330

SEQ ID NO: 23403 - protein, 469 aa, Artificial Sequence
  neuraminidase__InfluenzaA__AGJ73332
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNHNLEYQIGYICSGIFGDNPRPNDKTGSCGPVSSNGANGVKGFSFKYGNGVWIGRTKSISSRNGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 23404 - protein, 469 aa, Artificial Sequence; identical to SEQ ID NO: 20257
  neuraminidase__InfluenzaA__AGJ73334

SEQ ID NO: 23405 - protein, 469 aa, Artificial Sequence; identical to SEQ ID NO: 20257
  neuraminidase__InfluenzaA__AGJ73336

SEQ ID NO: 23406 - protein, 469 aa, Artificial Sequence; identical to SEQ ID NO: 20257
  neuraminidase__InfluenzaA__AGJ73338

SEQ ID NO: 23407 - protein, 469 aa, Artificial Sequence
  neuraminidase__InfluenzaA__AGJ73340
MNPNQKIITIGSVCMTIGMANLILQIGNIISIWISHSIQLGNQSQIETCNQSVITYENNTWVNQTYVNISNTNFAAGQSVVSVKLAGNSSLCPASGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23408 - protein, 469 aa, Artificial Sequence
  neuraminidase__InfluenzaA__AGJ73342
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSGTVGWSWPDGAELPFTIDK

SEQ ID NO: 23409 - protein, 469 aa, Artificial Sequence; identical to SEQ ID NO: 20709
  neuraminidase__InfluenzaA__AGJ73344

SEQ ID NO: 23410 - protein, 469 aa, Artificial Sequence
  neuraminidase__InfluenzaA__AGJ73346
MNPNQKIITIGSVCMTIGMANLILQIGNIISIWISHSIQLGNQNQIEKCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKESTIWTSGSSISFCGVNSDTVGWSWPDGAELPFTIDK

SEQ ID NO: 23411 - protein, 469 aa, Artificial Sequence
  neuraminidase__InfluenzaA__AGJ73348
MNPNQKIITIGSVCMTIGMANLILQIGNIISIWISHSIQLGNQNQIETCNQSVITYENNTWVNQTYVNISNTNFAAGQSVISVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23412 - protein, 469 aa, Artificial Sequence
  neuraminidase__InfluenzaA__AGJ73350
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDEHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVVMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23413 - protein, 469 aa, Artificial Sequence
  neuraminidase__InfluenzaA__AGJ73352
MNPNQKIITIGSVCMTIGMANLILQIGNIISIWISHSIQLGNQSQIETCNQSVITYENNTWVNQTYVNISNTNFAAGQSVVSVKLVGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDSPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23414 - protein, 469 aa, Artificial Sequence; identical to SEQ ID NO: 20709
  neuraminidase__InfluenzaA__AGJ73354

SEQ ID NO: 23415 - protein, 469 aa, Artificial Sequence
  neuraminidase__InfluenzaA__AGJ73356
MNPNQKIITIGSVCMTIGMANLILQIGNIISIWISHSIQLGNQSQIETCNQSVITYENNTWVNQTYFNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23416 - protein, 469 aa, Artificial Sequence; identical to SEQ ID NO: 20709
  neuraminidase__InfluenzaA__AGJ73358

SEQ ID NO: 23417 - protein, 469 aa, Artificial Sequence; identical to SEQ ID NO: 20709
  neuraminidase__InfluenzaA__AGJ73360

SEQ ID NO: 23418 - protein, 469 aa, Artificial Sequence
  neuraminidase__InfluenzaA__AGJ73362
MNPNQKIITIGSVCMTIGMANLILQIGNIISIWISHSIQLGNQSQIETCNQSVITYENNTWVNQTYVNISNTNFADGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23419 - protein, 469 aa, Artificial Sequence; identical to SEQ ID NO: 21832
  neuraminidase__InfluenzaA__AGJ73364

SEQ ID NO: 23420 - protein, 469 aa, Artificial Sequence; identical to SEQ ID NO: 20709
  neuraminidase__InfluenzaA__AGJ73366

SEQ ID NO: 23421 - protein, 469 aa, Artificial Sequence; identical to SEQ ID NO: 20257
  neuraminidase__InfluenzaA__AGJ73370

SEQ ID NO: 23422 - protein, 469 aa, Artificial Sequence
  neuraminidase__InfluenzaA__AGJ73372
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNHNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23423 - protein, 469 aa, Artificial Sequence; identical to SEQ ID NO: 20257
  neuraminidase__InfluenzaA__AGJ73374

SEQ ID NO: 23424 - protein, 469 aa, Artificial Sequence
  neuraminidase__InfluenzaA__AGJ73376
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKILRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSTKQDIVGINEWSGYSGSFVQHPELTGLDCIRPCFWVELIRGRPKENTIWTSGSSISFCGVNSDTVGWSWPDGAELPFTIDK

SEQ ID NO: 23425 - protein, 469 aa, Artificial Sequence
  neuraminidase__InfluenzaA__AGJ73379
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIIGINEWSGYSGSFVQHPELTGLDCIRPCFWVELIRGRPKENTIWTSGSSISFCGVNSDTVGWSWPDGAELPFTIDK

SEQ ID NO: 23426 - protein, 469 aa, Artificial Sequence
  neuraminidase__InfluenzaA__AGJ73381
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDEHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23427 - protein, 469 aa, Artificial Sequence
  neuraminidase__InfluenzaA__AGK62992
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEVKSCINRCFYVELIRGRKEETEVLWTSNSIVVFCGTSGTYGTGSWPDGADINLMPI

SEQ ID NO: 23428 - protein, 469 aa, Artificial Sequence
  neuraminidase__InfluenzaA__AGK62996
MNPNQKIITIGSVSLIISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVESKSCINRCFYVELIRGRKEETEVLWTSNSIVVFCGTSGTYGTGSWPDGADINLMPI

SEQ ID NO: 23429 - protein, 469 aa, Artificial Sequence
  neuraminidase__InfluenzaA__AGK62998
MNPNQKIITIGSVSLTIATICFFMQIAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLLGDTPRKNDSSSSSHCLDPNNEEGGHGVKGWAFDDGNDVWMGRTISEKSRLGYETFKVIEGWSNPKSKLQINRQVIVDRGDRSGYSGIFSVESKSCINRCFYVELIRGRKEETEVLWTSNSIVVFCGTSGTYGTGSWPDGADINLMPI

SEQ ID NO: 23430 - protein, 469 aa, Artificial Sequence
  neuraminidase__InfluenzaA__AGK63000
MNPNQKIITIGSVSLTIATICFFMQIAILITTVTLHFKQCDFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADINLMPI

SEQ ID NO: 23431 - protein, 469 aa, Artificial Sequence
  neuraminidase__InfluenzaA__AGK63002
MNPNQKIITIGSVSLTISTICFFMQIAILMTTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGNDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTITETSRLGYETFKVIEGWSNPKSKLQINRQVIVDRGDRSGYSGIFSVEGKSCINRCFYVELIRGRKEETEVLWTSNSIVVFCGTSGTYGTGSWPDGADINLMPI

SEQ ID NO: 23432 - protein, 469 aa, Artificial Sequence
  neuraminidase__InfluenzaA__AGK63004
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSSQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADINLMPI

SEQ ID NO: 23433 - protein, 469 aa, Artificial Sequence
  neuraminidase__InfluenzaA__AGK63006
MNPNQKIITIGSVSLTIATICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASAKADTKILFIEEGKIVHTSTLSGSAQHVEECSCYPRYSGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSQLQINRQVIVDRGDRSGYSGIFSVESKSCINRCFYVELIRGRKEETEVLWTSNSIVVFCGTSGTYGTGSWPDGADINLMPI

SEQ ID NO: 23434 - protein, 469 aa, Artificial Sequence
  neuraminidase__InfluenzaA__AGK63008
MNPNQKIITIGSVSLTIATICFFMQIAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQMNRQVIVDRGDRSGYSGIFSVEGKSCINRCFYVELIRGRKEETEVLWTSNSIVVFCGTSGTYGTGSWPDGADINLMPI

SEQ ID NO: 23435 - protein, 469 aa, Artificial Sequence
  neuraminidase__InfluenzaA__AGK63010
MNPNQKIITIGSVSLTIATICFFMQIAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSDPKSKLQINRQVIVDRGDRSGYSGIFSVEGKSCINRCFYVELIRGRKEETEVLWTSNSIVVFCGTSGTYGTGSWPDGADINLMPI

SEQ ID NO: 23436 - protein, 469 aa, Artificial Sequence
  neuraminidase__InfluenzaA__AGK63012
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGYRSGYSGIFSVEGKSCINRCFYVDLIRGRKEETEVLWTSNSIVVFCGTSGTYGTGSWPDGADINLMPI

SEQ ID NO: 23437 - protein, 469 aa, Artificial Sequence
  neuraminidase__InfluenzaA__AGK63014
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFPLGTKQVCIAWSSSSCHDGKAWLHVCITGDDKNATASFIYNGRLVDSVVSWSKEIHRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 23438 - protein, 469 aa, Artificial Sequence
  neuraminidase__InfluenzaA__AGK63018
MNPNQKIITIGSVSLTISTICFFMQIAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADINLMPI

SEQ ID NO: 23439 - protein, 469 aa, Artificial Sequence
  neuraminidase__InfluenzaA__AGK63020
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADINLMPI

SEQ ID NO: 23440 - protein, 469 aa, Artificial Sequence
  neuraminidase__InfluenzaA__AGK63022
MNPNQKIITIGSVSLTISTICFFMQIAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVDLIRGRKEETEVLWTSNSIVVFCGTSGTYGTGSWPDGADINLMPI

SEQ ID NO: 23441 - protein, 469 aa, Artificial Sequence; identical to SEQ ID NO: 23439
  neuraminidase__InfluenzaA__AGK63024

SEQ ID NO: 23442 - protein, 469 aa, Artificial Sequence; identical to SEQ ID NO: 23439
  neuraminidase__InfluenzaA__AGK63026

SEQ ID NO: 23443 - protein, 469 aa, Artificial Sequence
  neuraminidase__InfluenzaA__AGK63028
MNPNQKIITIGSVSLTISTICFFMQIAILITTVTLHFKQYEFNSPPNNQVMLCEPTIIERNKTEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKVVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEAKSCIIRCFYVELIRGRKEETEVLWTSNSIVVFCGTSGTYGTGSWPDGADINLMPI

SEQ ID NO: 23444 - protein, 469 aa, Artificial Sequence; identical to SEQ ID NO: 23438
  neuraminidase__InfluenzaA__AGK63030

SEQ ID NO: 23445 - protein, 469 aa, Artificial Sequence
  neuraminidase__InfluenzaA__AGK63032
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTITETSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 23446 - protein, 469 aa, Artificial Sequence
  neuraminidase__InfluenzaA__AGK63034
MNPNQKIITIGSVSLTISTICFFMQIAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKVHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKKETEVLWTSNSIVVFCGTSGTYGTGSWPDGADINLMPI

SEQ ID NO: 23447 - protein, 469 aa, Artificial Sequence
  neuraminidase__InfluenzaA__AGK63036
MNPNQKIITIGSVSLTISTICFFMQIAILITTVTLHFKQYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRFGYETIKVIEGWSNPKSNLQINRQVIVDRGNRSGYSGIFSVEGKSCINRCFYVELIRGRKEETEVLWTSNSIVVFCGTSGTYGTGSWPDGADINLMPI

SEQ ID NO: 23448 - protein, 469 aa, Artificial Sequence
  neuraminidase__InfluenzaA__AGK63038
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGDHGVKGWAFDDGNDVWMGRTINETSRLGYETFKVIEGWSNPKSKLQINRQVIVDRGNRSGYSGIFSVESKSCINRCFYVELIRGRKEETEVLWTSNSIVVFCGTSGTYGTGSWPDGADINLMPI

SEQ ID NO: 23449 - protein, 469 aa, Artificial Sequence
  neuraminidase__InfluenzaA__AGK63040
MNPNQKIITIGSVSLTISTICFFMQIAILITTVTLHFKQCEFNSPPNNQVMLCEPTIIERNITEIVYLTNTTIEKEICPKLAEYRNWSKPQCNITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADINLMPI

SEQ ID NO: 23450 - protein, 469 aa, Artificial Sequence
  neuraminidase__InfluenzaA__AGK63042
MNPNQKIITIGSVSLTISTICFFMQIAILITTVTLHFKQCEFNPPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADINLMPI

SEQ ID NO: 23451 - protein, 469 aa, Artificial Sequence
  neuraminidase__InfluenzaA__AGK63044
MNPNQKIITIGSVSLTISTICFFMQIAILITTVTLHFKQCEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCMAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGYRSGYSGIFSVESKSCINRCFYVELLRGRKEETEVLWTSNSIVVFCGTSGTYGTGSWPDGADINLMPI

SEQ ID NO: 23452 - protein, 469 aa, Artificial Sequence
  neuraminidase__InfluenzaA__AGK63046
MNPNQKIITIGSVSLTISTICFFMQIAILITTVTLHFKHYEFNSPPNNQVMLCEPTIIERNITEIVYLTNTTIEKEICPKPAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVDLIRGRKEETEVLWTSNSIVVFCGTSGTYGTGSWPDGADINLMPI

SEQ ID NO: 23453 - protein, 465 aa, Artificial Sequence
  neuraminidase__InfluenzaA__AGK82159
MNPNQKILCTSATAIIIGAIAVLIGIANLGLNIGLHLKPGCNCSHSQPETTNTSQTIINNYYNETNITNIQMEERTSRNFNNLTKGLCTINSWHIYGKDNAVRIGESSDVLVTREPYVSCDPDECRFYALSQGTTIRGKHSNETIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGAKIEYFL

SEQ ID NO: 23454 - protein, 465 aa, Artificial Sequence
  neuraminidase__InfluenzaA__AGK84858
MNPNQKILCTSATAIIIGAIAVLIGIANLGLNIGLHLKPGCNCSHSQPETTNTSQTIINNYYNETNITNIQMEERTSRNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGAKIEYFL

SEQ ID NO: 23455 - protein, 465 aa, Artificial Sequence
  neuraminidase__InfluenzaA__AGK84861
MNPNQKILCTSATAIIIGAIAVLIGIANLGLNIGLHLKPSCNCSHSQPETTNTSQTIINNYYNETNITNIQMEERTSRNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVVQIDPVAMTHTSQYICSPVLTDNPRPNDPNIGKCNDPYPGINNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGAKIEYFL

SEQ ID NO: 23456 - protein, 465 aa, Artificial Sequence; identical to SEQ ID NO: 23454
  neuraminidase__InfluenzaA__AGK84864

SEQ ID NO: 23457 - protein, 465 aa, Artificial Sequence
  neuraminidase__InfluenzaA__AGL95090
MNPNQKILCTSATAIIIGAIAVLIGIANLGLNIGLHLKPGCNCSHSQPETTNTSQTIINNYYNETNINNIQMEERTSRNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCKDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNADWSGYSGSFMDYWAEGDCYRACFYVELIRGRPKEDKVWWTSNSIVSMCSSTEFLGQWNWPDGAKIEYFL

SEQ ID NO: 23458 - protein, 470 aa, Artificial Sequence; identical to SEQ ID NO: 16632
  neuraminidase__InfluenzaA__AGL96802

SEQ ID NO: 23459 - protein, 470 aa, Artificial Sequence; identical to SEQ ID NO: 16632
  neuraminidase__InfluenzaA__AGL96807

SEQ ID NO: 23460 - protein, 470 aa, Artificial Sequence
  neuraminidase__InfluenzaA__AGL96808
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSFFSVKQDVVAITDWSGYSGSFVQHPELTGLDCIRPCFWVELVRGLPRENTTIWTSGSSISFCGVNSDTANWSWPDGAELPFTIDK

SEQ ID NO: 23461 - protein, 470 aa, Artificial Sequence
  neuraminidase__InfluenzaA__AGL96809
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKTASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 23462 - protein, 470 aa, Artificial Sequence; identical to SEQ ID NO: 16632
  neuraminidase__InfluenzaA__AGL96818

SEQ ID NO: 23463 - protein, 470 aa, Artificial Sequence
  neuraminidase__InfluenzaA__AGL96820
MNPNQKIITTGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVTVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 23464 - protein, 470 aa, Artificial Sequence
  neuraminidase__InfluenzaA__AGL96821
MNPNQKIITIGSISIAIGIISLMLQIGNIISIWASHSIQTGSQNNTGICNQRIITYENSTWVNHTYVNINNTNVVAGEDKTSVTLAGNSSLCSISGWAIYTKDNSIRIGSKGDVFVIREPFISCSHLECRTFFLTQGALLNDKHSNGTVKDRSPYRALMSCPLGEAPSPYNSKFESVAWSASACHDGMGWLTIGISGPDNGAVAVLKYNGIITGTIKSWKKQILRTQESECVCMNGSCFTIMTDGPSNKAASYKIFKIEKGKVTKSIELNAPNFHYEECSCYPDTGIVMCVCRDNWHGSNRPWVSFNQNLDYQIGYICSGVFGDNPRPEDGEGSCNPVSVDGANGVKGFSYKYDNGVWIGRTKSNRLRKGFEMIWDPNGWTNTDSDFSVKQDVVAITDWSGYSGSFVQHPELTGLDCIRPCFWVELVRGLPRENTTIWTSGSSISFCGVNSDTANWSWPDGAELPFTIDK

SEQ ID NO: 23465 - protein, 469 aa, Artificial Sequence
  neuraminidase__InfluenzaA__AGN69269
MITNQRIITIGTVCLIVGIVSLLLQIGNIVSLWISHSIQTGEKNHSEICNQNTITYENNTWVNQTYVNISNTNIADGQGVTSIILAGNSSLCPISGWAIYSKDNSIRIGSKGDIFVIREPFISCSHLECRTFFLTQGALLNDRHSNGTVKDRSPYRTLMSCPIGEAPSPYNSRFESVAWSASACHDGMGWITIGISGPDNGAVAVLKYNGIITDTIKSWRNKILRTQESECVCINGSCFTIMTDGPSNGQASYKIFKMEKGKIIKSVELDAPNYHYEECSCYPDTGKVVCVCRDNWHASNRPWVSFDQNLDYQIGYICSGVFGDNPRSNDGKGNCGPALSNGANGVKGFSFRYGNGVWIGRTKSISSRSGFEMIWDPNGWTETDSSFSMKQDIIALTDWSGYSGSFVQHPELTGMNCIRPCFWVELIRGQPKESTIWTSGSSISFCGVDSETASWSWPDGADLPFTIDK

SEQ ID NO: 23466 - protein, 469 aa, Artificial Sequence
  neuraminidase__InfluenzaA__AGN69280
MNTNQRIITIGTVCLIVGIVSLLLQIGNIVSLWISHSIQTGEKNHSEICNQNTITYENNTWVNQTYVNISNTNIADGQGVTSIILAGNSSLCPISGWAIYSKDNSIRIGSKGDIFVIREPFISCSHLECRTFFLTQGALLNDRHSNGTVKDRSPYRTLMSCPIGEAPSPYNSRFESVAWSASACHDGMGWLTIGISGPDNGAVAVLKYNGIITDTIKSWRNKILRTQESECVCINGSCFTIMTDGPSNGQASYKIFKMEKGKIIKSVELDAPNYHYEECSCYPDTGKVVCVCRDNWHASNRPWVSFDQNLDYQIGYICSGVFGDNPRSNDGKGNCGPVLSNGANGVKGFSFRYGNGVWIGRTKSISSRSGFEMIWDPNGWTETDSSFSMKQDIIALTDWSGYSGSFVQHPELTGMNCIRPCFWVELIRGQPKESTIWTGGSSISFCGVDSETASWSWPDGADLPFTIDK

SEQ ID NO: 23467 - protein, 469 aa, Artificial Sequence
  neuraminidase__InfluenzaA__AGN69292
MNPNQKIITIGSICMTIGIASLILQIGNIISIWISHSIQTENQNQPEICNQNVITYENNTWVNQTYVNISNTNFVAEQAVASVKLAGNSSLCPVSGWAIYSKDNSVRIGSKGDVFVIREPFISCSHLECRTFFLTQGALLNDKHSNGTIKDRSPYRTLMSCPIGEVPSPYNSRFESVAWSASACHDGTSWLTIGISGPDNGAVAVLKYNGIITDTIKSWRKNILRTQESECACVNGSCFTVMTDGPSNGQASYKVFKIEKGKVVKSVELNAPNYHYEECSCYPESGEITCVCRDNWHGSNRPWVSFNQNLEYQMGYICSGIFGDNPRPNDKTGSCGPVFSNGANGVKGFSFKYGNGVWIGRTKSISSRMGFEMIWDPDGWTKTDDKFSVKQDIIGINDWSGYSGSFVQHPELTGLDCMRPCFWVELIRGRPKENTIWTSGSSISFCGVNSDTVGWSWPDGAELPFTIDK

SEQ ID NO: 23468 - protein, 469 aa, Artificial Sequence
  neuraminidase__InfluenzaA__AGN69316
MNPNQKIITIGSICMTIGIASLILQIGNIISIWISHSIQTENQNQPEICNQNVITYENNTWVNQTYVNISNTNFVAEQAVASVKLAGNSSLCPVSGWAIYSKDNSVRIGSKGDVFVIREPFISCSHLECRTFFLTQGALLNDKHSNGTIKDRSPYRTLMSCPIGEVPSPYNSRFESVAWSASACHDGTSWLTIGISGPDNGAVAVLKYNGIITDTIKSWRKNILRTQESECACVNGSCFTVMTDGPSNGQASYKVFKIEKGKVVKTVELNAPNYHYEECSCYPESGEITCVCRDNWHGSNRPWVSFNQNLEYQMGYICSGIFGDNPRPNDKTGSCGPVFSNGANGVKGFSFKYGNGVWIGRTKSISSRMGFEMIWDPDGWTKTDDKFSVKQDIIGINDWSGYSGSFVQHPELTGLDCMRPCFWVELIRGRPKENTIWTSGSSISFCGVNSDTVGWSWPDGAELPFTIDK

SEQ ID NO: 23469 - protein, 469 aa, Artificial Sequence; identical to SEQ ID NO: 23468
  neuraminidase__InfluenzaA__AGN69328

SEQ ID NO: 23470 - protein, 469 aa, Artificial Sequence
  neuraminidase__InfluenzaA__AGN69340
MNPNQKIITIGLICMTIGIASLILQIGNIISIWISHSIQTENQNKPEICNQNVITYENNTWVNQTYVNVSNTNFVAEQAVASVKLVGNSSLCPVSGWAIYSKDNSVRIGSKGDVFVIREPFISCSHLECRTFFLTQGALLNDKHSNGTIKDRSPYRTLMSCPIGEVPSPYNSRFESVAWSASACHDGTSWLTIGISGPDNGAVAVLKYNGIITDTIKSWRKNILRTQESECACVNGSCFTVMTDGPSNGQASYKVFKIERGKVVKSVELNAPNYHYEECSCYPESSEITCVCRDNWHGSNRPWVSFNQNLEYQMGYICSGVFGDNPRPNDKTGSCGPVFSNGANGVKGFSFKYGNGVWIGRTKSTSSRMGFEMIWDPDGWTKTDDKFSVKQDIIGITDWSGYSGSFVQHPELTGLDCMRPCFWVELIRGRPKENTIWTSGSSISFCGVNSDTVGWSWPDGAELPFTIDK

SEQ ID NO: 23471 - protein, 469 aa, Artificial Sequence
  neuraminidase__InfluenzaA__AGO00268
MNPNQKIITIGSICMVVGIISLILQIGNIISIWISHSIQTGSQNHTGICNQSIITYKNSTWVNQTYVNISNTNVVAGKDTTSMILAGNSSLCPIRGWAIYSKDNGIRIGSKGDVFVIREPFISCSHLECRTFFLTQGALLNDKHSNGTVKDRSPYRALMSCPVGEAPSPYNSRFESVAWSASACHDGMGWLTIGISGPDDGAVAVLKYNGIITETIKSWKKKILRTQESECVCVNGSCFTIMTDGPSDGPASYKIFKIEKGKVTKSIELDAPNSHYEECSCYPDTGKVMCVCRDNWHGSNRPWVSFDQNLDYQIGYICSGVFGDNPRPKDGKGSCGPVYVDGANGVKGFSYRYGDGVWIGRTKSNSSRQGFEMIWDPNGWTETDSSFFVKQDVVAMTDWSGYSGSFVQHPELTGLNCMRPCFWVELIRGRPKEKTIWTSGSSISFCGVNSDTVDWSWPDGAELPFTIDK

SEQ ID NO: 23472 - protein, 469 aa, Artificial Sequence
  neuraminidase__InfluenzaA__AGO00280
MNPNQKIITIGSICMVVGIISLILQIGNIVSIWISHSIQTGNQNHTGTCNQSIITYKNSTWVNQTYVNISNTNVVAGKDTTSVILAGNSSLCPIRGWAIYSKDNGVRIGSKGDVFVIREPFISCSHLECRTFFLTQGALLNDKHSNGTVKDRSPYRALMSCPVGEAPSPYNSRFESVAWSASACHDGMGWLTIGISGPDDGAVAVLKYNGIITETIKSWRKEILRTQESECVCVNGSCFTIMTDGPSGGPASYKIFKIEKGKVTKSIELDAPNSHYEECSCYPDTSKVMCVCRDNWHGSNRPWVSFDQNLDYQMGYICSGVFGDNPRPKDGKGSCGPVYVDGANGVKGFSYRYGNGVWIGRTKSNSSRQGFEMIWDPNGWTETDSNFFMKQDVVAVTDWSGYSGSFVQHPELTGLDCMRPCFWVELIRGRPKENTIWTSGSSISFCGVNSDTVDWSWPDGAELPFTIDK

SEQ ID NO: 23473 - protein, 470 aa, Artificial Sequence
  neuraminidase__InfluenzaA__AGO00292
MNPNQKIITIGSICMTIGTISLILQIGNIISIWISHSIQTGSQNHTGICNQRIITYENNTWVNQTYVNISNTNVVAGKDTTSMILAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITEIIKSWRKQILRTQESECVCVNGSCFTIMTDGPSDGPASYRIFKIEKGKITKSIELDAPNSHYEECSCYPDTGKVMCVCRDNWHGSNRPWVSFNQNLDYQIGYICSGVFGDNPRPKDGKGSCDPVNVDGADGVKGFSYRYGDGVWIGRTKSNSSRKGFEMIWDPNGWTDTDDNFLVKQDVVAMTDWSGYSGSFVQHPELTGLDCIRPCFWVELIRGRPREKTTIWTSGSSISFCGVNSDTVNWSWPDGAELPFTIDM

SEQ ID NO: 23474 - protein, 470 aa, Artificial Sequence
  neuraminidase__InfluenzaA__AGO00304
MNPNQKIITIGSICMAIGTISLILQIGNIISIWISHSIQTGSQNHTGICNQRIITYENNTWVNQTYVNISNTNVVAGKDTTSMILAGNTSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITEIIKSWRKQILRTQESECVCVNGSCFTIMTDGPSNGPASYRIFKIEKGKITKSIELDAPNSHYEECSCYPDTGKVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTNTDGNFSVKQDVVAMTDWSGYSGSFVQHPELTGLDCMRPCFWVELIRGRPREKTTIWTSGSSISFCGVNSDTVNWSWPDGAELPFTIDK

SEQ ID NO: 23475 - protein, 469 aa, Artificial Sequence; identical to SEQ ID NO: 22544
  neuraminidase__InfluenzaA__AGO00316

SEQ ID NO: 23476 - protein, 469 aa, Artificial Sequence; identical to SEQ ID NO: 21988
  neuraminidase__InfluenzaA__AGO00328

SEQ ID NO: 23477 - protein, 469 aa, Artificial Sequence; identical to SEQ ID NO: 14095
  neuraminidase__InfluenzaA__AGO00340

SEQ ID NO: 23478 - protein, 454 aa, Artificial Sequence; identical to SEQ ID NO: 15719
  neuraminidase__InfluenzaA__AGO00352

SEQ ID NO: 23479 - protein, 454 aa, Artificial Sequence; identical to SEQ ID NO: 15719
  neuraminidase__InfluenzaA__AGO00376

SEQ ID NO: 23480 - protein, 454 aa, Artificial Sequence; identical to SEQ ID NO: 15719
  neuraminidase__InfluenzaA__AGO00388

SEQ ID NO: 23481 - protein, 454 aa, Artificial Sequence; identical to SEQ ID NO: 15719
  neuraminidase__InfluenzaA__AGO00400

SEQ ID NO: 23482 - protein, 454 aa, Artificial Sequence; identical to SEQ ID NO: 15719
  neuraminidase__InfluenzaA__AGO00412

SEQ ID NO: 23483 - protein, 454 aa, Artificial Sequence; identical to SEQ ID NO: 15719
  neuraminidase__InfluenzaA__AGO00424

SEQ ID NO: 23484 - protein, 454 aa, Artificial Sequence
  neuraminidase__InfluenzaA__AGO00436
MNPNQKIITIGSICLVVGLISLILQIGNIISIWISHSIQTGSQNHTGICNQNIITYKNSTWVKDTTSVILTGNSSLCPIRGWAIYSKDNSIRIGSKGDVFVIREPFISCSHLECRTFFLTQGALLNDKHSSGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSDGLASYKIFKIEKGKVTKSIELNAPNSNYEECSCYPDTGKVMCVCRDNWHGSNRPWVSFDQNLDYQIGYICSGVFGDNPRPEDGTGSCGPVYVDGANGVKGFSYRYGNGVWIGRTKSHSSRHGFEMIWDPNGWTETDSKFSVRQDVVAMTDWSGYSGSFVQHPELTGLDCMRPCFWVELIRGRPKEKTIWTSASSISFCGVNSDTVDWSWPDGAELPFSIDK

SEQ ID NO: 23485 - protein, 454 aa, Artificial Sequence
  neuraminidase__InfluenzaA__AGO00448
MNPNQKIITIGSICLVVGLISLILQIGNIISIWISHSIQTGSQNHTGICNQNIITYKNSTWVKDTTSVILTGNSSLCPIRGWAIYSKDNSIRIGSKGDVFVIREPFISCSHLECRTFFLTQGALLNDKHSSGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSDGLASYRIFKIEKGKVTKSIELNAPNSHYEECSCYPDTGKVMCVCRDNWHGSNRPWVSFDQNLDYQIGYICSGVFGDNPRPEDGTGSCGPVYVDGANGVKGFSYRYGNGVWIGRTKSHSSRHGFEMIWDPNGWTETDSKFSVRQDVVAMTDWSGYSGSFVQHPELTGLDCMRPCFWVELIRGRPKEKTIWTSASSISFCGVNSDTVDWSWPDGAELPFSIDK

SEQ ID NO: 23486 - protein, 469 aa, Artificial Sequence
  neuraminidase__InfluenzaA__AGQ47722
MNTNQRIITIGTICLIVGIISLLLQIGNIISLWISHSIQTGEKSHPEICNQSVITYENNTWVNQTYVNISNTNIAAGQGVTPIILAGNSSLCPISGWAIYSKDNSIRIGSKGDIFVMREPFISCSHLECRTFFLTQGALLNDRHSNGTVKDRSPYRTLMSCPIGEAPSPYNSRFESVAWSASACHDGMGWLTIGISGPDNGAVAVLKYNGIITDTIKSWRNKILRTQESECVCINGSCFTIMTDGPSNGQASYKIFKMEKGKIIKSIELDAPNYHYEECSCYPDTGKVMCVCRDNWHASNRPWVSFDQNLDYQIGYICSGVFGDNPRSNDGKGNCGPVLSNGANGVKGFSFRYGNGVWIGRTKSISSRSGFEMVWDPNGWTETDSSFSMKQDIIALTDWSGYSGSFVQHPELTGMNCIRPCFWVELIRGQPKESTIWTSGSSISFCGVNSGTASWSWPDGADLPFTIDK

SEQ ID NO: 23487 - protein, 470 aa, Artificial Sequence; identical to SEQ ID NO: 16453
  neuraminidase__InfluenzaA__AGQ47731

SEQ ID NO: 23488 - protein, 458 aa, Artificial Sequence
  neuraminidase__InfluenzaA__AGQ47743
MNPNQKIITIGSICMVVGIISLILQIGNIISIWISHSIQTGNQNHKNSTWMNQTYINISNTNVVAGQDSTSVILTGNSSLCPIRGWAINSKDNGIRIGSKGDVFVIREPFISCSHLECRTFFLTQGALLNDKHSNGTVKDRSPYRALMSCPVGEAPSPYNSRFESVAWSASACHDGMGWLTIGISGPDNGAVAVLKYNGIITETIKSWRKKILRTQESECTCVNGSCFTIMTDGPSNGLASYKIFKIEKGKVTKSIELNAPNSHYEECSCYPDTGKVMCVCRDNWHGSNRPWVSFDQNLDYQIGYICSGVFGDNPRPKDGTGSCGPVSADGANGVKGFSYRYGNGVWIGRTKSNSSRHGFEMIWDPNGWTETDSRFSVRQDVVAMTDRSGYSGSFVQHPELTGLDCMRPCFWVELIRGRPEEETIWTSGSIISFCGVNSDTVDWSWPDGAELPFTIDK

SEQ ID NO: 23489 - protein, 470 aa, Artificial Sequence
  neuraminidase__InfluenzaA__AGQ47755
MNPNQKIITIGSICMAIGTISLILQIGNIISIWISHSIQTGSQNHTGICNRRIVTYENNTWVNQTYVNISNTNVVAEKDTTSMILAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITEIIKSWRKQILRTQESECVCVNGSCFTIMTDGPSNGPASYRIFKIKKGKITKSIELDAPNSHYEECSCYPDTGKVMCVCRDNWHGSNRPWVSFNQNLDYQIGYICSGVFGDNPRPKDGKGSCDPVNVDGADGVKGFSYRYGNGVWIGRTKSTSSRKGFEMIWDPNGWTDTDGNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 23490 - protein, 469 aa, Artificial Sequence
  neuraminidase__InfluenzaA__AGQ47767
MNPNQKIITIGSICMVVGIISLILQIGNIVSIWISHSIQTGNQNHTGTCDQSIITYKNSTWVNQTYVNISNTNVVAGKDTTSVILAGNSSLCPIRGWAIYSKDNGVRIGSKGDVFVIREPFISCSHLECRTFFLTQGALLNDKHSNGTVKDRSPYRALMSCPVGEAPSPYNSRFESVAWSASACHDGMGWLTIGISGPDDGAVAVLKYNGIITETIKSWRKEILRTQESECVCVNGSCFTIMTDGPSGGPASYKIFKIEKGKVTKSIELDAPNSHYEECSCYPDTSKVMCVCRDNWHGSNRPWVSFDQNLDYQMGYICSGVFGDNPRPKDGKGSCGPVYVDGANGVKGFSYKYGNGVWIGRTKSNSSRQGFEMIWDPNGWTETDSNFFTKQDVVAVTDWSGYSGSFVQHPELTGLDCMRPCFWVELIRGRPKENTIWTSGSSISFCGVNSDTVDWSWPDGAELPFTIDK

SEQ ID NO: 23491 - protein, 469 aa, Artificial Sequence; identical to SEQ ID NO: 23472
  neuraminidase__InfluenzaA__AGQ47779

SEQ ID NO: 23492 - protein, 470 aa, Artificial Sequence
  neuraminidase__InfluenzaA__AGQ47791
MNPNQKIITIGSICMAIGIISLILQIGNIISIWVSHSIQTGSQNHTGICNQRIITYENNTWVNQTHVNISNTNVVAGKDTTSMILAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWKKQILRTQESECVCVNGSCFTIMTDGPSDGPASYRIFKIEKGKITKSIELDAPNSHYEECSCYPDTGTVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDGNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 23493 - protein, 469 aa, Artificial Sequence
  neuraminidase__InfluenzaA__AGQ47803
MNPNQKIITIGSICMVVGIISLILQIGNIISIWISHSIQTGSQNHTGICNQSIITYKNSTWVNQTYVNISNTNVVAGKGTTSVILAGNSSLCPIRGWAIYSKDNGIRIGSKGDVFVIREPFISCSHLECRTFFLTQGALLNDKHSNGTVKDRSPYRALMSCPVGEAPSPYNSRFESVAWSACACHDGMGWLTIGISGPDDEAVAVLKYNGIITETIKSWRKKILRTQESECVCVNGSCFTIMTDGPSDGPASYKIFKIEKGKVTKSIELDAPNSHYEECSCYPDTGKVMCVCRDNWHGSNRPWVSFDQNLDYQIGYICSGVFGDNPRPKDGKGSCGPVYVDGANGVKGFSYRYGNGVWIGRTKSDSSRQGFEMIWDPNGWTETDSNFFVKQDIVAMTDWSGYSGSFVQHPELTGLDCMRPCFWVELIRGRPKEKTIWTSGSSISFCGVNSDTVDWSWPDGAELPFTIDK

SEQ ID NO: 23494 - protein, 455 aa, Artificial Sequence
  neuraminidase__InfluenzaA__AGQ47814
MNPNQKIITIGSICMAIGIISLILQIGNIISIWVSHSIQTGSQNHTGICNQRIITYENNTWVKDTTSMTLAGNSSLCPIRGWAIYSKDNSIRIGSKGDVFVIREPFISCSHLECRTFFLTQGALLNDKHSNGTVKDRSPYRALMSCPIGEAPSPYNSRFESVAWSASACHDGMGWLTIGISGPDDGAVAVLKYNGIITETIKSWKKQILRTQESECVCVNGSCFTIMTDGPSDGPASYRIFKIEKGKITKSIELDAPNSHYEECSCYPDTGTVMCVCRDNWHGSNRPWVSFNQNLDYQIGYICSGVFGDNPRPKDGKGSCDPVNVDGADGVKGFSYRYGNGVWIGRTKSNSSRKGFEMIWDPNGWTDTDGNFLVKQDVVAMTDWSGYSGSFVQHPELTGLDCMRPCFWVELIRGRPREKTTIWTSGSSISFCGVNSDTVNWSWPDGAELPFTIDK

SEQ ID NO: 23495 - protein, 470 aa, Artificial Sequence; identical to SEQ ID NO: 16457
  neuraminidase__InfluenzaA__AGQ47826

SEQ ID NO: 23496 - protein, 469 aa, Artificial Sequence
  neuraminidase__InfluenzaA__AGQ47838
MNPNQKIITIGSVSLTIATICFLMQIAILVTTVTLHFKQYECDSPANNQVMPCEPIIIERNITEIVYLTNTTIEKEICPKLVGYRNWSKPQCKITGFAPFSKDNSIRLSAGGDIWVTREPYVSCDPGKCYQFALGQGTTLDNKHSNDTIHDRTPHRTLLMNELGVPFHLGTKQVCIAWSSSSCHDGKAWLHVCVTGYDKNATASFIYDGRLVDSIGSWSQNILRTQESECVCINGTCTVVMTDGSASGRADTKILFIEEGKIVHISPLSGSAQHVEECSCYPRYPGVRCICRDNWKGSNRPVVDINVKDYSIDSSYVCSGLVGDTPRNNDRSSSSYCRNPNNEKGNHGVKGWAFDDGNDVWMGRTISEDSRSGYETFKVIGGWSTPNSKLQINRQVIVDSDNRSGYSGIFSVEGKSCINRCFYVELIRGREQETRVWWTSNSIVVFCGTSGTYGTGSWPDGADINLMPI

SEQ ID NO: 23497 - protein, 453 aa, Artificial Sequence
  neuraminidase__InfluenzaA__AGQ47850
MNPNQKIITIGSICMVVGIISLILQIGNIISIWISHSIQAGSSTWVNQTYVNISNTNVVAGPDATSVILTGNSSLCPIRGWAIYSKDNGIRIGSKGDIFVIREPFISCSHLECRAFFLTQGALLNDKHSNGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSDGPASYKIFKIEKGKVTKSIELDAPNSHYEECSCYPDTGKVMCVCRDNWHGSNRPWVSFDQNLDYQIGYICSGVFGDSPRPKDGTGSCGPVSVDGANGVKGFSYRYGNGVWIGRTKSKSSRHGFEMIWDPNGWTETDSRFSVRQDVVAMTDWSGYSGSFVQHPELTGLDCMRPCFWVELIRGQPKEKTIWTSGSSISFCGVNSDTVDWSWPDGAELPFTIDK

SEQ ID NO: 23498 - protein, 469 aa, Artificial Sequence
  neuraminidase__InfluenzaA__AGQ47873
MNTNQRTITIGTICLIVGIISLLLQIGNIILLWMSHSIQTGEKSHPKVCNQSVITYENNTWVNQTYVNISNTNIAAGQGVTPIILAGNSSLCPISGWAIYSKDNSIRIGSKGDIFVMREPFISCSHLECRTFFLTQGALLNDRHSNGTVKDRSPYRTLMSCPIGEAPSPYNSRFESVAWSASACHDGMGWLTIGISGPDNGAVAVLKYNGIITDTIKSWRNKILRTQESECVCINGSCFTIMTDGPSNGQASYKLFKMEKGKIIKSIELDAPNYHYEECSCYPDTGKVVCVCRDNWHASNRPWVSFDQNLDYQIGYICSGVFGDNPRSNDGKGNCGPVLSNGANGVKGFSFRYGNGVWIGRTKSISSRSGFEMIWDPNGWTETDSSFSMKQDIIALTDWSGYSGSFVQHPELTGMNCIRPCFWVELIRGQPKESTIWTSGSSISFCGVNSGTASWSWPDGADLPFTIDK

SEQ ID NO: 23499 - protein, 469 aa, Artificial Sequence; identical to SEQ ID NO: 17214
  neuraminidase__InfluenzaA__AGQ47885

SEQ ID NO: 23500 - protein, 469 aa, Artificial Sequence; identical to SEQ ID NO: 21980
  neuraminidase__InfluenzaA__AGQ47897

SEQ ID NO: 23501 - protein, 469 aa, Artificial Sequence; identical to SEQ ID NO: 14095
  neuraminidase__InfluenzaA__AGQ47909

SEQ ID NO: 23502 - protein, 469 aa, Artificial Sequence
  neuraminidase__InfluenzaA__AGQ47921
MNPNQKIITIGSVSLTIATVCFLMQTAILVTTVTLHFKQYECDSPASNQVMPCEPIIIERNITEIVYLNNTTIEKEICPKVVEYRNWSKPQCQITGFAPFSKDNSIRLSAGGDIWVTREPYVSCDHGKCYQFALGQGTTLDNKHSNDTIHDRIPHRTLLMNELGVPFHLGTRQVCIAWSSSSCHDGKAWLHVCITGDDKNATASFIYDGRLVDSIGSWSQNILRTQESECVCINGTCTVVMTDGSASGRADTRILFIEEGKIVHISPLSGSAQHVEECSCYPRYPGVRCICRDNWKGSNRPVVDINMEDYSIDSSYVCSGLVGDTPRNDDRSSNSNCRNPNNERGNQGVKGWAFDNGDDVWMGRTISKDLRSGYETFKVIGGWSTPNSKSQINRQVIVDSDNRSGYSGIFSVEGKSCINRCFYVELIRGRKQEARVWWTSNSIVVFCGTSGTYGTGSWPDGANINFMPI

SEQ ID NO: 23503 - protein, 454 aa, Artificial Sequence
  neuraminidase__InfluenzaA__AGQ47933
MNPNQKIITIGSICMVVGLISLILQIGNIISIWISHSIQTGSQNHTGICNQNIITYKNSTWVKDTTSVILTGNSSLCPIRGWAIYSKDNSIRIGSKGDVFVIREPFISCSHLECRTFFLTQGALLNDRHSNGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSDGLASYKIFKIEKGKVTKSIELNAPNSHYEECSCYPDTGKVMCVCRDNWHGSNRPWVSFDQNLDYQIGYICSGVFGDNPRPKDGTGSCGPVYVDGANGVKGFSYRYGNGVWIGRTKSHSSRHGFEMIWDPNGWTETDSKFSVRQDVVAMTDWSGYSGSFVQHPELTGLDCIRPCFWVELIRGRPKEKTIWTSASSISFCGVNSDTVNWSWPDGAELPFTIDK

SEQ ID NO: 23504 - protein, 454 aa, Artificial Sequence; identical to SEQ ID NO: 15719
  neuraminidase__InfluenzaA__AGQ47945

SEQ ID NO: 23505 - protein, 454 aa, Artificial Sequence; identical to SEQ ID NO: 15719
  neuraminidase__InfluenzaA__AGQ47957

SEQ ID NO: 23506 - protein, 454 aa, Artificial Sequence; identical to SEQ ID NO: 15719
  neuraminidase__InfluenzaA__AGQ47969

SEQ ID NO: 23507 - protein, 454 aa, Artificial Sequence; identical to SEQ ID NO: 15719
  neuraminidase__InfluenzaA__AGQ47981

SEQ ID NO: 23508 - protein, 454 aa, Artificial Sequence
  neuraminidase__InfluenzaA__AGQ48005
MNPNQKIITIGSICLVVGLISLILQIGNIISIWISHSIQTGSQNHTGICNQNIITYKNSTWVKDTTSVILTGNSSLCPIRGWAIYSKDNSIRIGSKGDVFVIREPFISCSHLECRTFFLTQGALLNDKHSSGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSDGLASYKIFKIEKGKVTKSIELNAPNSHYEECSCYPDTGKVMCVCRDNWHGSNRPWVSFDQNLDYQIGYICSGVFGDNPRPEDGTGSCGPVYVDGANGVKGFSYRYSNGVWIGRTKSHSSRHGFEMIWDPNGWTETDSKFSVRQDVVAMTDWSGYSGSFVQHPELTGLDCMRPCFWVELIRGRPKEKTIWTSASSISFCGVNSDTVDWSWPDGAELPFSIDK

SEQ ID NO: 23509 - protein, 454 aa, Artificial Sequence; identical to SEQ ID NO: 23508
  neuraminidase__InfluenzaA__AGQ48017

SEQ ID NO: 23510 - protein, 454 aa, Artificial Sequence; identical to SEQ ID NO: 15719
  neuraminidase__InfluenzaA__AGQ48029

SEQ ID NO: 23511 - protein, 454 aa, Artificial Sequence
  neuraminidase__InfluenzaA__AGQ48041
MNPNQKIITIGSICLVVGLISLILQIGNIISIWISHSIQTGSQNHTGICNQNIITYKNSTWIKDTTSVILTGNSSLCPIRGWAIYSKDNSIRIGSKGDVFVIREPFISCSHLECRTFFLTQGALLNDKHSSGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSDGLASYKIFKIEKGKVTKSIELNAPNSHYEECSCYPDTGKVMCVCRDNWHGSNRPWVSFDQNLDYQIGYICSGVFGDNPRPEDGTGSCGPVYVDGANGVKGFSYRYGNGVWIGRTKSHSSRHGFEMIWDPNGWTETDSKFSVRQDVVAMTDWSGYSGSFVQHPELTGLDCMRPCFWVELIRGRPKEKTIWTSASSISFCGVNSDTVDWSWPDGAELPFSIDK

SEQ ID NO: 23512 - protein, 454 aa, Artificial Sequence
  neuraminidase__InfluenzaA__AGQ48053
MNPNQKIITIGSICLVVGLISLILQIGNIISIWISHSIQTGSQNHTGICNQNIITYKNSTWIKDTTSVILTGNSSLCPIRGWAIYSKDNSIRIGSKGDVFVIREPFISCSHLECRTFFLTQGALLNDKHSSGTVKDRSPYRALMSCPVGEAPSPYNSRFESVAWSASACHDGMGWLTIGISGPDNGAVAVLKYNGIITETIKSWRKKILRTQESECACVNGSCFTIMTDGPSDGLASYKIFKIEKGKVTKSIELNAPNSHYEECSCYPDTGKVMCVCRDNWHGSNRPWVSFDQNLDYQIGYICSGVFGDNPRPEDGTGSCGPVYVDGANGVKGFSYRYGNGVWIGRTKSHSSRHGFEMIWDPNGWTETDSKFSVRQDVVAMADWSGYSGSFVQHPELTGLDCMRPCFWVELIRGRPKEKTIWTSASSISFCGVNSDTVDWSWPDGAELPFSIDK

SEQ ID NO: 23513 - protein, 469 aa, Artificial Sequence
  neuraminidase__InfluenzaA__AGQ81707
MNPNQKIITIGSICMVIGIASLMLQIGNMISIWVSHSIQTGNQYQPEPCNQSIITYENNTWVNQTYVNISNTNFLTEQAVTSVALAGNSSLCPISGWAIYSKDNGIRIGSKGDVFVIREPFISCSHLECRTFFLTQGALLNDKHSNGTVKDRSPYRTLMSCPVGEAPSPYNSRFESVAWSASACHDGISWLTIGISGPDNGAVAVLKYNGIITDTIKSWRNNILRTQESECACVNGSCFTVMTDGPSNGQASYKIFKIEKGKVVKSVELNAPNYHYEECSCYPDAGKIMCVCRDNWHGSNRPWVSFNQNLEYQIGYICSGVFGDNPRPNDGTGSCGPVSSNGAYGVKGFSFKYGNGVWIGRTKSTSSRSGFEMIWDPNGWTETDSSFSVKQDIVAITDWSGYSGSFVQHPELTGLDCMRPCFWVELIRGRPKENTIWTSGSSISFCGVDSDTVGWSWPDGAELPFTIDK

SEQ ID NO: 23514 - protein, 469 aa, Artificial Sequence
  neuraminidase__InfluenzaA__AGQ81715
MNPNQKIIAIGSVSLTIATICLLMQIAILVTTMTLHFKHNECTNSSNNQAVPCGPIIIERNVTEIVHLNSTTLEKEICPKAAGYRDWSKPQCQITGFAPFSKDNSIRLSASGDIWVTREPYVSCGLGKCYQFALGQGTTLDNRHSNGTSHDRTPYRTLLMNELGVPFHLATKQVCIAWSSSSCHDGKAWLHVCVTGDDRNATASIIYDGILVDSIGSWSKNILRTQESECVCINGTCTVVMTDGSASGKADTRILFIREGKIVHISPLSGSAQHVEECSCYPQYPEVRCVCRDNWRGSNRPVLYINMADYSIDSGYVCSGLVGDTPRNDDISSSSNCKDPNNERGAPGVKGWAFDSGNDIWMGRTIEKDSRSGYETFRVIGGWNTANSKSQTSRQVIVDSGNSSGYSGIFSIEGKSCINRCFYVELIRGRPKETRVWWTSNSIIVFCGTSGTYGTGSWPDGANINFMAI

SEQ ID NO: 23515 - protein, 469 aa, Artificial Sequence
  neuraminidase__InfluenzaA__AGQ81717
MNPNQKIIAIGSVSLTIATICLLMQIAILVTTMTPHFKHDECTNSSNNQAVPCGPIIIERNVTEIVHINSTILEKEICPKAAGYRNWSKPQCQIIGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGMLVDSIGSWSKNILRTQESECVCINGTCTVVMTDGSASGKADTRILFIREGKIVHISPLSGSAQHVEECSCYPQYPEVRCVCRDNWRGSNRPVLYINMADYSIDSGYVCSGLVGDTPRNDDISSSSNCKDPNNERGAPGVKGWAFDSGNDIWMGRTIEKDSRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMAI

SEQ ID NO: 23516 - protein, 469 aa, Artificial Sequence
  neuraminidase__InfluenzaA__AGQ81718
MNPNQKIIAIGSVSLTIATICLLMQIAILVTTMTLHFKHNECTNSSNNQAVPCGPIIIERNLTEIVHLNSTILEKEICPKAAGYRNWSKPQCQITGFAPFSKDNSIRLSASGDIWVTREPYVSCGLGKCYQFALGQGTTLDNRHSNGTSHDRTPHRTLLMNELGVPFHLSTKQVCIAWSSSSCHDGKAWLHVCVTGDDRNATASIIYDGILVDSIVSWSKNILRTQESECVCINGTCTVVMTDGSASGKADTRILFIREGKIVHISPLSGSAQHVEECSCYPRYPEVRCVCRDNWRGSNRPVLYINMADYSIDSGYVCSGLVGDTPRNDDTSSSSNCRDPNNERGAPGVKGWAFDSGNDIWMGRTIEKDSRSGYETFRVIGGWNTANSKSQTSRQVIVDSDNSSGYSGVFSVEGKSCINRCFYVELIRGRPKETRVWWTSNSIIVFCGTSGTYGTGSWPDGANINFMAI

SEQ ID NO: 23517 - protein, 469 aa, Artificial Sequence
  neuraminidase__InfluenzaA__AGQ81719
MNPNQKIIAIGSVSLTIATICLLMQIAILVTTMTLHFKHNECTNSSNNQAVPCGPIIIERNVTEIVHLNSTTLEKEICTKAAGYRDWSKPQCQITGFAPFSKDNSIRLSASGDIWVTREPYVSCGLGKCYQFALGQGTTLDNRHSNGTTHDRTPHRTLLMNELGVPFHLATKQVCIAWSSSSCHDGKAWLHVCVTGDDRNATASIIYDGILVDSIGSWSKNILRTQESECVCINGTCTVVMTDGSASGKADTRILFIREGKIVHISPLSGSAQHVEECSCYPQYPEVRCVCRDNWRGSNRPVLYINMADYSIDSGYVCSGLVGDTPRNDDISSNSNCKDPNNESGAPGVKGWAFDSGNDIWMGRTIEKDSRSGYETFRVIGGWNTANSKSQTSRQVIVDSDNSSGYSGIFSIEGKSCINRCFYVELIRGRPKETRVWWTSNSIIVFCGTSGTYGTGSWPDGANINFMAI

SEQ ID NO: 23518 - protein, 469 aa, Artificial Sequence
  neuraminidase__InfluenzaA__AGQ81722
MNPNQKIIAIGSVSLTIATICLLMQIAILVTTMTPHFKHDECTNSSNNQAVPCGPIIIERNVTEIVHINSTILEKGICPKAAGYRNWSKPQCQIIGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGMLVDSIGSWSKNILRTQESECVCINGTCTVVMTDGSASGKADTRILFIREGKIVHISPLSGSAQHVEECSCYPQYPEVRCVCRDNWRGSNRPVLYINMADYSIDSGYVCSGLVGDTPRNDDTSSSSNCKDPNNERGAPGVKGWAFDSGNDIWMGRTIEKDSRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMAI

SEQ ID NO: 23519 - protein, 469 aa, Artificial Sequence
  neuraminidase__InfluenzaA__AGQ81724
MNPNQKIIAIGSVSLTIATICLLMQIAILVTTMTLHFKHNECSNSSNNQAVPCGPIIIERNVTEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGILVDSIGSWSKNILRTQESECVCINGTCTVVMTDGSASGKADTRILFIREGKIVHISPLSGSAQHVEECSCYPQYPEVRCVCRDNWRGSNRPVLYINMEDYSIDSGYVCSGLVGDTPRNDDISSSSNCKDPNNERGAPGVKGWAFDSGNDLWMGRTIEKDSRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMAI

SEQ ID NO: 23520 - protein, 469 aa, Artificial Sequence
  neuraminidase__InfluenzaA__AGQ81726
MNPNQKIIAIGSVSLTIATICLLMQIAILVTTMTLHFKHNECSNSSNNQAVPCGPIIIERNITEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGILVDSIGSWSKNILRTQESECVCIKRTCTVVMTDGSASGKADTRILFIREGKIVHISPLSGSAQHVEECSCYPQYPEVRCVCRDNWRGSNRPVLYINMADYSIDSGYVCSGLVGDTPRNDDISSSSNCKDPNNERGAPGVKGWAFDSGNDLWMGRTIEKESRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMAI

SEQ ID NO: 23521 - protein, 469 aa, Artificial Sequence
  neuraminidase__InfluenzaA__AGQ81727
MNPNQKIIAIGSVSLTIATICLLMQVAILVTTMTLHFKHNECSNSSNNQAVPCGPIIIERNITEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGRAWLHVCVTGDDRNATASIIYDGILVDSIGSWSKNILRTQESECVCINGTCTVVMTDGSASGKADTRILFIREGKIVHISPLSGSAQHVEECSCYPQYPEVRCVCRDNWRGSNRPVLYINMADYSIDSGYVCSGLVGDTPRNDDISSSSNCKDPNNERGAPGVKGWAFDSGNDLWMGRTIEKESRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23522 - protein, 469 aa, Artificial Sequence
  neuraminidase__InfluenzaA__AGQ81728
MNPNQKIVAIGSVSLTIATMCLLMQIALFATTMTLHFKQTGSTNSSDNQAVPCGPIIIERNITEIVHLNSTTLEKETCPKSAGYRNWSKPQCQITGFAPFSKDNSIRLSAGGDIWVTREPYVSCGLGKCYQFALGQGTTLDNKHSNGTTYDRTPHRTLLMNELGVPFHLATKQVCIAWSSSSCHDGKAWLHVCVTGDDKNATASIIYDGILVDSIASWSKNILRTQESECVCINGTCTVVMTDGSASGRADTRILFIREGKIVHISPLSGSAQHVEECSCYPRYPEVRCVCRDNWKGSNRPVLYINMADYSIDSSYVCSGIVGDTPRNDDRSSSSNCRDPNNEIGAPGVKGWAFDSGNDIWMGRTIEKDSRSGYETFRVIGGWSTANSKSQINRQVIVDRDNSSGYSGIFSVEGKSCINRCFYVELIRGRPKENRVWWTSNSIIVFCGTSGTYGTGSWPDGANINLMPI

SEQ ID NO: 23523 - protein, 469 aa, Artificial Sequence
  neuraminidase__InfluenzaA__AGQ81729
MNPNQKIIAIGSVSLTIATICLLMQIAILVATMTLHSKHGECTNSSNNQAVPCGPIIIERNVTEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGIPFHLATKQVCIAWSSSSCHDGKAWLHVCVTGDDRNATASIIYDGMLVDSIGSWSKNILRTQESECVCINGTCTVVMTDGSASGKADTRILFIREGKIVHISPLLGSAQHVEECSCYPQYPEVRCVCRDNWRGSNRPVLYINMADYSVDSGYVCSGLVGDTPRNDDTSSSSNCKDPNNERGAPGVKGWAFDSGNDIWMGRTIEKDSRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23524 - protein, 469 aa, Artificial Sequence
  neuraminidase__InfluenzaA__AGQ81730
MNPNQKIIAIGSVSLTIATICLLMQIAILVTTMTLHFKHNECINSSNNQSVPCGPIIIERNVTEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLASKQVCIAWSSSSCHDGKAWLHVCVTGDDRNATASIIYDGMLVDSIGSWSKNILRTQESECVCINGTCTVVMTDGSASGEADTRILFIREGKIVHISPLSGSAQHVEECSCYPQYPEVRCVCRDNWRGSNRPVLYINMADYSIDSGYVCSGLVGDTPRNDDISSSSNCKDPNNERGAPGVKGWAFDSGNDIWMGRTIEKDSRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMAI

SEQ ID NO: 23525 - protein, 469 aa, Artificial Sequence
  neuraminidase__InfluenzaA__AGQ81731
MNPNQKIIAIGSVSLTIATICLLMQIAILVTTMTLHFKHNECSNSSNNQAVPCGPIIIERNITEIVHLNSTTLEKEICPKTAGYRDWSKPQCQITGFAPFSKDNSIRLSASGDIWVTREPYVSCGFGKCYQFALGQGTTLDNRHSNGTSHDRTPHRTLLMNELGVPFHLATKQVCIAWSSSSCHDGKAWLHVCVTGDDRNATASIIYDGILVDSIGSWSKNILRTQESECVCINGTCTVVMTDGSASGKADTRILFIREGKIVHISPLSGSAQHVEECSCYPQYPEVRCVCRDNWRGSNRPVLYINMTDYSIDSGYVCSGLVGDTPRNDDISSSSNCKDPNNERGAPGVKGWAFDSGNDLWMGRTIEKESRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMAI

SEQ ID NO: 23526 - protein, 469 aa, Artificial Sequence
  neuraminidase__InfluenzaA__AGQ81732
MNPNQKIIAIGSVSLTIATICLLMQVAILVTTMTLHFKHNECSNSSNNQAVPCGPIIIERNITEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGILVDSIGSWSKNILRTQESECVCINGTCTVVMTDGSASGKADTRILFIREGKIVHISPLSGSAQHVEECSCYPQYPEVRCVCRDNWRGSNRPVLYINMADYSIDSGYVCSGLVGDTPRNDDISSSSNCKDPNNERGAPGVKGWAFDSGNDLWMGRTIEKESRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23527 - protein, 469 aa, Artificial Sequence
  neuraminidase__InfluenzaA__AGQ81733
MNPNQKIIAIGSVSLTIATICLLMQIAILVTTMTLHFKHNECSNSSNSQAVPCGPIIIERNVTEIVHLNSTTLEKEICPKAAEYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGILVDSIGSWSKNILRTQESECVCINGTCTVVMTDGSASGKADTRILFIREGKIVHISPLSGSAQHVEECSCYPQYPEVRCVCRDNWRGSNRPVLYINMADYSIDSGYVCSGLVGDTPRNDDISSSSNCKDPNNERGAPGVKGWAFDSGNDLWMGRTIEKDSRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23528 - protein, 469 aa, Artificial Sequence
  neuraminidase__InfluenzaA__AGQ81734
MNPNQKIIAIGSVSLTIATICLLMQIAILVTTMTLHFKHNEYSNSSNNQAVPCGPIIIERNITEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGILVDSIGSWSKNILRTQESKCVCIKRTCTVVKTDGSASGKADTRILFIREGKIVHISPLSGSAQHVEECSCYPQYPEVRCVCRDNWRGSNRPVLYINMADYSIDSGYVCSGLVGDTPRNDDISSSSNCKDPNNERGAPGVKGWAFDSGNDLWMGRTIEKESRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMAI

SEQ ID NO: 23529 - protein, 469 aa, Artificial Sequence; identical to SEQ ID NO: 23527
  neuraminidase__InfluenzaA__AGQ81735

SEQ ID NO: 23530 - protein, 469 aa, Artificial Sequence
  neuraminidase__InfluenzaA__AGQ81736
MNPNQKIIAIGSVSLTIATICLLMQIAILVATMTLHSKHGECTDSSNNQAVPCGPIIIERNVTEIVHLNSTTLEKEICPKAAGYKDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGMLVDSIGSWSKNILRTQESECVCINGTCTVVMTDGSASGKADTRILFIREGKIAHISPLSGSAQHVEECSCYPQYPEVRCVCRDNWRGSNRPVLYINMADYSVDSGYVCSGLVGDTPRNDDTSSSSNCKDPNNERGAPGVKGWAFDSGNDIWMGRTIEKDSRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23531 - protein, 469 aa, Artificial Sequence
  neuraminidase__InfluenzaA__AGQ81737
MNPNQKIIAIGSVSLTIATICLLMQIAILVTTMTLHFKHNECSNSSNNQAVPCGPIIIERNITEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGILVDSIGSWSKNILRTQESECVCINGTCTVVMTDGSASGKADTRILFIREGKIVHISPLSGSAQHVEECSCYPQYPEVRCVCRDNWRGSNRPVLYINMADYSIDSGYVCSGLVGDTPRNDDISSSSNCKDPNNERGAPGVKGWAFDSGNDLWMGRTIEKESRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMAI

SEQ ID NO: 23532 - protein, 469 aa, Artificial Sequence
  neuraminidase__InfluenzaA__AGQ81738
MNPNQKIIAIGSVSLTIATICLLMQVAILVTTMTLHFKHNECSNSSNNQAVPCGPIIIERNITEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGILVDSIGSWSKNILRTQESECVCINGTCTVVMTDGSASGKADTRILFIREGKIIHISPLSGSAQHVEECSCYPQYPEVRCVCRDNWRGSNRPVLYINMADYSIDSGYVCSGLVGDTPRNDDISSSSNCKDPNNERGAPGVKGWAFDSGNDLWMGRTIEKESRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23533 - protein, 469 aa, Artificial Sequence
  neuraminidase__InfluenzaA__AGQ81739
MNPNQKIIAIGSVSLTIATICLLMQIAILVTTMTLHFKHDECTNSSNNQAVPCEPIIIERNVTEIVHINSTILEKEICPKAAGYRNWSKPQCQITGFAPFSKDNSIRLSASGDIWVTREPYVSCGLGKCYQFALGQGTTLDNRHSNGTLNDRTPHRTLLMNELGVPFHLATKQVCIAWSSSSCHDGKAWLHVCVTGDDRNATASIIYDDMLVDSIGSWSKNILRTQESECVCINGTCTVVMTDGSASGKADTRILFIREGKIVHISPLSGSAQHVEECSCYPQYPEVRCVCRDNWRGSNRPVLYINMADYSIDSGYVCSGLVGDTPRNDDISSSSNCKDPNNERGAPGVKGWAFDSGNDIWMGRTIEKDSRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMAI

SEQ ID NO: 23534 - protein, 469 aa, Artificial Sequence
  neuraminidase__InfluenzaA__AGQ81740
MNPNQKIVAIGSVSLTIATICLLMQIAILVTTMTLHFKHGECTNSSNNQAVPCGPIIIERNITEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYNGILVDSIGSWSKNILRTQESECVCINGTCTVVMTDGSASGKADTRILFIREGKIVHISPLSGSAQHVEECSCYPQYPEVRCVCRDNWRGSNRPVLYINMADYSVDSGYVCSGLVGDTPRNDDTSSSSNCKDPNNERGAPGVKGWAFDSGNDIWMGRTIEKDLRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23535 - protein, 469 aa, Artificial Sequence
  neuraminidase__InfluenzaA__AGQ81741
MNPNQKIVAIGSVSLTIATICLLMQIAILVTTMTLHFKHGECTNSSNNQAVPCGPIIIERNITEIVHLNSTTLDKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGMLVDSIGSWSKNILRTQESECVCINGTCTVVMTDGSASGKADTRILFIREGKIVHISPLSGSAQHVEECSCYPQYPEVRCVCRDNWRGSNRPVLYINMADYSVDSGYVCSGLVGDTPRNDDTSSSSNCKDPNNERGAPGVKGWAFDSGNDIWMGRTIEKDLRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23536 - protein, 469 aa, Artificial Sequence
  neuraminidase__InfluenzaA__AGQ81742
MNPNQKIVAIGSVSLTIATICLLMQIAILVTTMTLHFKHGECTNSSNNQAVPCGPIIIERNITEIVHLNSTTLEKEICPKAAEYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGMLVDSIGSWSKNILRTQESECVCINGTCTVVMTDGSASGKADTRILFIREGKIVHISPLSGSAQHVEECSCYPQYPEVRCVCRDNWRGSNRPVLYINMADYSVDSGYVCSGLVGDTPRNDDTSSSSNCKDPNNERGAPGVKGWAFDSGNDIWMGRTIEKDLRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23537 - protein, 469 aa, Artificial Sequence
  neuraminidase__InfluenzaA__AGQ81744
MNPNQKIIAIGSVSLTIATICLLMQIAILVTTMTLHFRHDECTNSSNNQAVPCGPIIIERNVTEIVHLNSTTLEKEICPKAAEYRDWSKPQCQITGFVPFSKDNSIRLSAGGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGMLVDSIGSWSKNILRTQESECVCINGTCTVVMTDGSASGKADTRILFIREGKIVHISPLSGSAQHVEECSCYPQYPEVRCVCRDNWRGSNRPVLYINVADYSVDSGYVCSGLVGDTPRNDDISSSSNCKDPNNERGAPGVKGWAFDSGNDIWMGRTIEKDSRSGYETFRVIGGWNTANSKSQTSRQVIVDSDNPSGYSGIFSVEGKSCINRCFYVELIRGRPKETRVWWTSNSIIVFCGTSGTYGTGSWPDGANINFMPI

SEQ ID NO: 23538 - protein, 469 aa, Artificial Sequence
  neuraminidase__InfluenzaA__AGQ81746
MNPNQKIIAIGSVSLTIATICLLMQIAILVTTMTLHFKHNECSNSSNSQAVPCGPIIIERNVTEIVHLNSTTLEKEICPKAAEYRGWSKPQCQITGFAPFSKDNSIRLSASGDIWVTREPYVSCDLGKCYQFALGQGTTLDNRHSNGTSHDRTPHRTLLMNELGVPFHLATKQVCIAWSSSSCHDGKAWLHVCVTGDDRNATASIIYDGILVDSIGSWSKNILRTQESECVCINGTCTVVMTDGSASGKADTRILFIREGKIVHISPLSGSAQHVEECSCYPQYPEVRCVCRDNWRGSNRPVLYINMADYSIDSGYVCSGLVGDTPRNDDISSSSNCKDPNNERGAPGVKGWAFDSGNDLWMGRTIEKDSRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23539 - protein, 469 aa, Artificial Sequence
  neuraminidase__InfluenzaA__AGQ81747
MNPNQKIVAIGSVSLTIATICLLMQIAILVTTMTLHFKHGECTNSSNNQAVPCGPIIIERNITEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGMLVDSIGSWSKNILRTQESECVCINGTCTVVMTDGSASGKADTRILFIREGKIVHISPLSGSAQHVEECSCYPQYPEVRCVCRDNWRGSNRPVLYINMADYSVDSGYVCSGLVGDTPRNDDTSSSSNCKDPNNERGAPGVKGWAFDSGNDIWMGRTIEKDLRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23540 - protein, 466 aa, Artificial Sequence
  neuraminidase__InfluenzaA__AGQ81749
MNPNQKIIAIGSVSLTTAIICFLMQIAILTTTMTLHFKQNECSNPSNNQVVPCEPIIIERNTVHLNSTTIEKEICSKVAEYKNWSKPQCQITGFAPFSKDNSIRLSAGGDIWVTREPYVSCSLGKCYQFALGQGTTLKNKHSNGTTHDRIPHRTLLMNELGVPFHLGTKQVCIAWSSSSCYDGKAWLHICVTGDDKNATASIIYDGMLADSIGSWSKNILRTQESECVCINGTCAVVMTDGSASGKADTRILFIREGRIINISPLSGSAQHVEECSCYPRYPEVRCVCRDNWKGSNRPVLYINMADYSVESSYVCSGLVGDTPRNDDSSSSSNCRDPNNERGAPGVKGWAFDDGNDVWMGRTIKKDSRSGYETFRVINGWTTANSKSQINRQVIVDSDNWSGYSGIFSVEGKNCINRCFYVELIRGRPQEPKVWWTSNSIIAFCGTSGTYGTGSWPDGANINFMPI

SEQ ID NO: 23541 - protein, 466 aa, Artificial Sequence; identical to SEQ ID NO: 23540
  neuraminidase__InfluenzaA__AGQ81750

SEQ ID NO: 23542 - protein, 469 aa, Artificial Sequence
  neuraminidase__InfluenzaA__AGQ81751
MNPNQKIIAIGSVSLTIATICLLMQIAILVTTMTLYFKHNECSNSSNNQAVPCGPIIIERNITEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGILVDSIGSWSKNILRTQESECVCINGTCTVVMTDGSASGKADTRILFIREGKIVHISPLSGSAQHVEECSCYPQYPEVRCVCRDNWRGSNRPVLYINMADYSIDSGYVCSGLVGDTPRNDDISSSSNCKDPNNERGAPGVKGWAFDSGNDLWMGRTIEKESRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23543 - protein, 469 aa, Artificial Sequence
  neuraminidase__InfluenzaA__AGQ81753
MNPNQKIVAIGSVSLTIATICLLMQIAILVTTMTLHFKHGECTNSSNNQAVPCGPIIIERNITGIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHICVTGDDRNATASIIYDGMLVDSIGSWSKNILRTQESECVCINGTCTVVMTDGSASGKADTRILFIREGKIVHISPLSGSAQHVEECSCYPQYPEVRCVCRDNWRGSNRPVLYINMADYSVDSGYVCSGLVGDTPRNDDTSSSSNCKDPNNERGAPGVKGWAFDSGNDIWMGRTIEKDLRSGYETFRVIGGWNTANSKSQTNRQVIVDSDNSSGYSGIFSVEGKSCINRCFYVELIRGRPKETRVWWTSNSIIVFCGTSGTYGTGSWPDGANINFMPI

SEQ ID NO: 23544 - protein, 469 aa, Artificial Sequence; identical to SEQ ID NO: 23543
  neuraminidase__InfluenzaA__AGQ81754

SEQ ID NO: 23545 - protein, 469 aa, Artificial Sequence
  neuraminidase__InfluenzaA__AGQ81756
MNPNQKIIAIGSISLTIATICLLIQIAILVTTMTLHFKHGECTNSSNNQAVPCGPIIIERNVTEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGLLVDSIGSWSKNILRTQESECVCINGTCTVVMTDGSASGKADTRILFIREGKIIHISPLSGSAQHVEECSCYPQYPEVRCVCRDNWRGSNRPVLYINMADYSVDSGYVCSGLVGDTPRNDDTSSSSNCKDPNNERGAPGVKGWAFDSGNDIWMGRTIEKDSRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23546 - protein, 469 aa, Artificial Sequence
  neuraminidase__InfluenzaA__AGQ81757
MNPNQKIIAIGSVSLTIATICLLIQIAILVTTMTLHFKHGECTNSSNNQAVPCGPIIIERNVTEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMNELGVPFHLATKQVCIAWSSSSCHDGKAWLHVCVTGDDRNATASIIYDGLLVDSIGSWSKNILRTQESECVCINGTCTVVMTDGSASGKADTRILFIREGKIIHISPLSGSAQHVEECSCYPQYPEVRCVCRDNWRGSNRPVLYINMADYSVDSGYVCSGLVGDTPRNDDTSSSSNCKDPNNERGAPGVKGWAFDSGNDIWMGRTIEKDSRSGYETFRVIGGWNTANSKSQTSRQVIVDSDNSSGYSGIFSVEGKSCINRCFYVELIRGRPKETRVWWTSNSIIVFCGTSGTYGTGSWPDGANINFMPI

SEQ ID NO: 23547 - protein, 466 aa, Artificial Sequence
  neuraminidase__InfluenzaA__AGQ81758
MNPNQKIIAIGSVSLIIAIICLLMQIAILTTTMTLHFRQNECSNPSNNQVVPCEPTIIERNTVHLNSTTIEREICPKVAEYKNWSKPQCQITGFAPFSKDNSIRLSAGGDIWVTREPYVSCSLGKCYQFALGQGTTLKNKHSNGTTHDRTPHRTLLMNELGVPFHLGTKQVCIAWSSSSCYDGKAWLHICVTGDDENATASIIYDGMLVDSIGSWSKNILRTQESECVCINGTCAVVMTDGSASGKADTRVLFIREGKIINISPLSGSAQHVEECSCYPRYPEVRCVCRDNWKGSNRPVLYINMADYSIESSYVCSGLVGDTPRNDDSSSSSNCRDPNNERGAPGVKGWAFDDGNDVWMGRTIKNDSRSGYETFRVVNGWTMANSKSQINRQVIVDSDNWSGYSGIFSVEGKKCINRCFYVELIRGRPQEPRVWWTSNSIIVFCGTSGTYGTGSWPDGANINFMPI

SEQ ID NO: 23548 - protein, 466 aa, Artificial Sequence
  neuraminidase__InfluenzaA__AGQ81759
MNPNQKIIAIGSVSLTIAIICFLIQIAILTTTMTLHFRQSECSNPSNNQVVPCEPIIIERNTVHLNSTIIEKEICPKVAEYKNWSKPQCQITGFAPFSKDNSIRLSAGGDIWVTREPYVSCSLGKCYQFALGQGTTLKNKHSNGTTHDRIPHRTLLMNELGVPFHLGTKQVCIAWSSSSCHDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSIESSYVCSGLVGDTPRDDDSSSSSNCRDPNNERGAPGVKGWAFDDGNDIWMGRTIKSDSRSGYETFRVINGWTTANSKSQINRQVIVDSDSWSGYSGIFSVEGKNCINRCFYVELIRGRPRETRVWWTSNSIIVFCGTSGTYGTGSWPDGANINFMPI

SEQ ID NO: 23549 - protein, 466 aa, Artificial Sequence
  neuraminidase__InfluenzaA__AGQ81760
MNPNQKIIAIGSVSLTIAIICFLMQIAILTTTMTLHFRQNECSNPSNNQVVPCEPIIIERNTVHLNSTTIEKEICPKVAEYKNWSKPQCQITGFAPFSKDNSIRLSAGGDIWVTREPYVSCSLGKCYQFALGQGTTLKNKHSNGTTHDRIPHRTLLMNELGVPFHLGTKQVCIAWSSSSCHDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPVLYINMADYSIESSYVCSGLVGDTPRDDDSSSSSNCRDPNNERGAPGVKGWAFDDGNDIWMGRTIKSDSRSGYETFRVVNGWITANSKSQINRQVIVDSDSWSGYSGIFSVEGKNCINRCFYVELIRGRPQETRVWWTSNSIIVFCGTSGTYGTGSWPDGANINFMPI

SEQ ID NO: 23550 - protein, 466 aa, Artificial Sequence
  neuraminidase__InfluenzaA__AGQ81761
MNPNQKIIAIGSVSLTIAIICFLMQIAILTTTMTLHFRQNECSNPSNNQVVPCEPIIIERNTVHLNSTTIEKEICPKVAEYKNWSKPQCQITGFAPFSKDNSIRLSAGGDIWVTREPYVSCSLGKCYQFALGQGTTLKNKHSNGTTHDRIPHRTLLMNELGVPFHLGTKQVCIAWSSSSCHDGKAWLHICVTGDDKNATASIIYDGMLVDSIGSWSKNILRTQESECVCINGTCAVVMTDGSASGKADTRILFIKEGKIINISPLSGSAQHVEECSCYPRYPEVRCVCRDNWKGSNRPVLYINMADYSIESSYVCSGLVGDTPRDDDSSSSSNCRDPNNERGAPGVKGWAFDDGNDIWMGRTIKSDSRSGYETFRVVNGWTTANSKSQINRQVIVDSDSWSGYSGIFSVEGKNCINRCFYVELIRGRPQETRVWWTSNSIIVFCGTSGTYGTGSWPDGANINFMPI

SEQ ID NO: 23551 - protein, 466 aa, Artificial Sequence
  neuraminidase__InfluenzaA__AGQ81763
MNPNQKIIAIGSVSLIIAIICLLMQIAILTTTMTLHFRQNECSNPSNNQVVPCEPIIIERNTVHLNSTTIEREICPKVAEYKNWSKPQCQITGFAPFSKDNSIRLSAGGDIWVTREPYVSCSLGKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPVLYINMADYSIESSYVCSGLVGDTPRNDDSSSSSNCRDPNNERGAPGVKGWAFDDGNDVWMGRTIKNGSRSGYETFRVVNGWTMANSKSQINRQVIVDSDNWSGYSGIFSVEGKKCINRCFYVELIRGRPQEPRVWWTSNSIIVFCGTSGTYGTGSWPDGANINFMPI

SEQ ID NO: 23552 - protein, 466 aa, Artificial Sequence
  neuraminidase__InfluenzaA__AGQ81766
MNPNQKIIAIGSVSLTIAIICFLMQIAILTTTMTLHFRQNECSNPSNNQVVPCEPIIIERNTVHLNSTTIEKEICPKVAEYKNWSKPQCQITGFAPFSKDNSIRLSAGGDIWVTREPYVSCSLGKCYQFALGQGTTLKNKHSNGTTHDRIPHRTLLMNELGVPFHLGTKQVCIAWSSSSCHDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSIESSYVCSGLVGDTPRDDDSFSSSNCRDPNNERGAPGVKGWAFDDGNDIWMGRTIKSDSRSGYETFRVVNGWTTANSKSQINRQVIVDSDSWSGYSGIFSVEGKNCINRCFYVELIRGRPQETIVWWTSNSIIVFCGTSGTYGTGSWPDGANINFMPI

SEQ ID NO: 23553 - protein, 466 aa, Artificial Sequence; identical to SEQ ID NO: 23552
  neuraminidase__InfluenzaA__AGQ81767

SEQ ID NO: 23554 - protein, 469 aa, Artificial Sequence
  neuraminidase__InfluenzaA__AGQ81768
MNPNQKIVAIGSVSLTIATICLLMQIAILVTTMTLHFKHGECTNSSNNQAVPCGPIIIERNITEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMSELGVPFHLATKQVCIAWSSSSCHDGEAWLHICVTGDDRNATASIIYDGMLVDSIGSWSKNILRTQESECVCINGTCTVVMTDGSASGKADTRILFIREGKIVHISPLSGSAQHVEECSCYPQYPEVRCVCRDNWRGSNRPVLYINMADYSVDSGYVCSGLVGDTPRNDDTSSSSNCKDPNNERGAPGVKGWAFDSGNDIWMGRTIEKDLRSGYETFRVIGGWNTANSKSQTNRQVIVDSDNSSGYSGIFSVEGKSCINRCFYVELIRGRPKETRVWWTSNSIIVFCGTSGTYGTGSWPDGANINFMPI

SEQ ID NO: 23555 - protein, 469 aa, Artificial Sequence
  neuraminidase__InfluenzaA__AGQ81769
MNPNQKIVAIGSVSLTIATICLLMQIAILVTTMTLHFKHGECTNSSNNQAVPCGPIIIERNITEIVHLNSTTLEKEICPKAAGYRDWSKPQCQITGFAPFSKDNSIRLSASGDIWVTREPYVSCGLGKCYQFALGQGTTLDNRHSNGTSHDRTPHRTLLMSELGVPFHLATKQVCIAWSSSSCHDGEAWLHICVTGDDRNATASIIYGGMLVDSIGSWSKNILRTQESECVCINGTCTVVMTDGSASGKADTRILFIREGKIVHISPLSGSAQHVEECSCYPQYPEVRCVCRDNWRGSNRPVLYINMADYSVDSGYVCSGLVGDTPRNDDTSSSSNCKDPNNERGAPGVKGWAFDSGNDIWMGRTIEKDLRSGYETFRVIGGWNTANSKSQTNRQVIVDSDNSSGYSGIFSVEGKSCINRCFYVELIRGRPKETRVWWTSNSIIVFCGTSGTYGTGSWPDGANINFMPI

SEQ ID NO: 23556 - protein, 466 aa, Artificial Sequence
  neuraminidase__InfluenzaA__AGQ81770
MNPNQKIIAIGSVSITIAIICFIMQIAILTTTMTLHFRQNECSNPSNNQVVPCEPIIIERNTVHLNSTTIEKETCPKVAEYKNWSKPQCQITGFAPFSKDNSIRLSAGGDIWVTREPYVSCSLGKCYQFALGQGTTLKNKHSNGTTHDRIPHRTLLMNELGVPFHLGTKQVCIAWSSSSCHDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPVLYINMADYSVESSYVCSGLVGDTPRDDDSSSSSNCRDPNNERGAPGVKGWAFDDGNDIWMGRTIKSDSRSGYETFRVVNGWTTANSKSQINRQVIVDSDSWSGYSGIFSVEGKNCINRCFYVELIRGRPQETRVWWTSNSIIVFCGTSGTYGTGSWPDGANINFMPI

SEQ ID NO: 23557 - protein, 469 aa, Artificial Sequence
  neuraminidase__InfluenzaA__AGQ81772
MNPNQKIVAIGSASLTIATMCLLLQIALFATTMTLHFKQTGCTNSSDNQAVPCGPIIIERNITEIVHLNSTTLEKETCPKSAGYRNWSKPQCQITGFAPFSKDNSIRLAAAGDIWVTREPYVSCGLGKCYQFALGQGTTLDNKHSNGTTHDRTPHRTLLMSELGVPFHLATKQVCIAWSSSSCHDGKAWLHVCVTGDDKNATASIIYDGILVDSIASWSKNILRTQESECVCINGTCTVVMTDGSASGRADTRILFIREGKIVHISPLSGSAQHVEECSCYPRYPEVRCVCRDNWKGSNRPVLFINMADYSIDSSYVCPGLVGDTPRNDDRSSSSNCRDPNNERGAPGVKGWAFDSGNDIWMGRTIEKDSRSGYETFRVISGWSTANSKSQINRQVIVDRDNSSGYSGIFSVEGKSCINRCFYVELIRGRPKENRVWWTSNSIIVFCGTSGTYGTGSWPDGANINLMPI

SEQ ID NO: 23558 - protein, 466 aa, Artificial Sequence
  neuraminidase__InfluenzaA__AGQ81773
MNPNQKIIAIGSVSLTIAIICFLMQIAILTTTMTLHFRQNECSNPSNNQVVPCEPIIIERKTVHLNSTTIEKEICPKVAEYKNWSKPQCQITGFAPFSKDNSIRLSAGGDIWVTREPYVSCSLGKCYQFALGQGTTLKNKHSNGTTHDRIPHRTLLMNELGVPLHWGTKQVCIAWSSSSCHDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPVLYINMADYSIESSYVCSGLVGDTPRDDDSSSSSNCRDPNNERGAPGVKGWGFDDGNDIWMGRTIKSDSRSGYETFRVVNGWTTANSKSQINRQVIVDSDSWSGYSGIFSVEGKNCINRCFYVELIRGRPQETRVWWTSNSIIVFCGTSGTYGTGSWPDGANINFMPI

SEQ ID NO: 23559 - protein, 466 aa, Artificial Sequence
  neuraminidase__InfluenzaA__AGQ81774
MNPNQKIIAIGSVSLIIAIICLLMQIAILTTTMTLHFRQNECSNPSNNQVMPCEPIIIERNTVHLNSTTIEREICPKVAEYKNWSKPQCQITGFAPFSKDNSIRLSAGGDIWVTREPYVSCSLDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTIANSKSQINRQVIVDSDDWSGYSGIFSVEGKKCINRCFYVELIRGRPQEPRVWWTSNSIIVFCGTSGTYGTGSWPDGANINFMPI

SEQ ID NO: 23560 - protein, 466 aa, Artificial Sequence
  neuraminidase__InfluenzaA__AGQ81776
MNPNQKIIAIGSVSLTIAIICFLMQIAILTTTMTLHFRQNECSNPSNNQVVPCEPIIIERNTVHLNSTTIEKEICPKVAEYKNWSKPQCQITGFAPFSKDNSIRLSAGGDIWVTREPYVSCSLGKCYQFALGQGTTLKNKHSNGTTHDRIPHRTLLMNELGVPFHLGTKQVCIAWSSSSCHDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPVLYINMADYSIESSYVCSGLVGDTPRDDDSSSSSNCRDPNNERGAPGVKGWAFDDGNDIWMGRTIKSDSRSGYETFRVIDGWTTADSKSQINRQVIVDSDSWSGYSGIFSVEGKNCINRCFYVELIRGRPQETRVWWTSNSIIVFCGTSGTYGTGSWPDGANINFMPI

SEQ ID NO: 23561 - protein, 469 aa, Artificial Sequence
  neuraminidase__InfluenzaA__AGQ81777
MNPNQKIVTIGSASLTIATMCLLLQIALFATTMTLHFKQTGCTNSSDNQAVPCGPIIIERNITEIVHLNSTTLEKETCPKSAGYRNWSKPQCQITGFAPFSKDNSIRLAAAGDIWVTREPYVSCGLGKCYQFALGQGTTLDNKHSNGTTHDRTPHRTLLMNELGVPFHLATKQVCIAWSSSSCHDGKAWLHVCVTGDDKNATASIIYDGILVDSIASWSKNILRTQESECVCINGTCTVVMTDGSASGRADTRILFIREGKIVHISPLSGSAQHVEECSCYPRYPEVRCVCRDNWNGSNRPVLFINMADYSIDSSYVCSGLVGDTPRNDDRSSSSNCRDPNNERGAPGVKGWAFDSGNDIWMGRTIEKDSRSGYETFRVISGWSTANSKSQINRQVIVDRDNSSGYSGIFSVEGKSCINRCFYVELIRGRPKENRVWWTSNSIIVFCGTSGTYGTGSWPDGANINLMPI

SEQ ID NO: 23562 - protein, 469 aa, Artificial Sequence
  neuraminidase__InfluenzaA__AGQ81778
MNPNQKIVTIGSASLTIATMCLLLQIALFATTMTLHFKQTGCTNSSDNQAVPCGPIIIERNITEIVHLNSTTLEKETCPKSAGYRNWSKPQCQITGFAPFSKDNSIRLAAAGDIWVTREPYVSCGLGKCYQFALGQGTTLDNKHSNGTTHDRTPHRTLLMNELGVPFHLATKQVCIAWSSSSCHDGKAWLHVCVTGDDKNATASIIYDGILVDSIASWSKNILRTQESECVCINGTCTVVMTDGSASGRADTRILFIREGKIVHISPLSGSAQHVEECSCYPRYPEVRCVCRDNWKGSNRPVLFINMADYSIDSSYVCSGLVGDTPRNDDRSSSSNCRDPNNERGAPGVKGWAFDSGNDIWMGRTIEKDSRSGYETFRVISGWSTANSKSQINRQVIVDRDNSSGYSGIFSVEGKSCINRCFYVELIRGRPKENRVWWTSNSIIVFCGTSGTYGTGSWPDGANINLMPI

SEQ ID NO: 23563 - protein, 469 aa, Artificial Sequence
  neuraminidase__InfluenzaA__AGQ81779
MNPNQKIVAIGSASLTIATMCLLLQIALFATTMTLHFKQTGCTNSSDNQAVPCGPIIIERNITEIVHLNSTTLEKETCPKSAGYRNWSKPQCQITGFAPFSKDNSIRLAAAGDIWVTREPYVSCGLGKCYQFALGQGTTLDNKHSNGTTHDRTPHRTLLMNELGVPFHLATKQVCIAWSSSSCHDGKAWLHVCVTGDDKNATASIIYDGILVDSIASWSKNILRTQESECVCINGTCTVVMTDGSASGRADTRILFIREGKIVHISPLSGSAQHVEECSCYPRYPEIRCVCRDNWKGSNRPVLFINMADYSIDSSYVCSGLVGDTPRNDDRSSSSNCRDPNNERGAPGVKGWAFDSGNDIWMGRTIEKDSRSGYETFRVISGWSTANSKSQINRQVIVDRDNSSGYSGIFSVEGKSCINRCFYVELIRGRPKENRVWWTSNSIIVFCGTSGTYGTGSWPDGANINLMPI

SEQ ID NO: 23564 - protein, 469 aa, Artificial Sequence
  neuraminidase__InfluenzaA__AGQ81780
MNPNQKIVAIGSASLTIATMCLLLQIALFATTMTLHFKQTGCTNSSDNQAVPCGPIIIERNITEIVHLNSTTLEKETCPKSAGYRNWSKPQCQITGFAPFSKDNSIRLAAAGDIWVTREPYVSCGLGKCYQFALGQGTTLDNKHSNGTTHDRTPHRTLLMNELGVPFHLATKQVCIAWSSSSCHDGKAWLHVCVTGDDKNATASIIYDGILVDSIASWSKNILRTQESECVCINGTCTVVMTDGSASGRADTRILFIREGKIVHISPLSGSAQHVEECSCYPRYPEVRCVCRDNWKGSNRPVLFINMADYSIDSSYVCSGLVGDTPRNDDRSSSSNCRDPNNERGASGVKGWAFDSGNDIWMGRTIEKDSRSGYETFRVISGWSTANSKSQINRQVIVDRDNSSGYSGIFSVEGKSCINRCFYVELIRGRPKENRVWWTSNSIIVFCGTSGTYGTGSWPDGANINLMPI

SEQ ID NO: 23565 - protein, 466 aa, Artificial Sequence
  neuraminidase__InfluenzaA__AGQ81781
MNPNQKIIAIGSVSLTIAIICFLMQIAILTTTMTPHFRQNECSNPSNNQVVPCEPIIIERNTVHLNSTTIEKEICPKVAEYKNWSKPQCQITGFAPFSKDNSIRLSAGGDIWVTREPYVSCSLGKCYQFALGQGTTLKNKHSNGTTHDRIPHRTLLMNELGVPFHLGTKQVCIAWSSSSCHDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSIESSYVCSGLVGDTPRDDDSSSSSNCRDPNNERGAPGVKGWAFDDGNDIWMGRTIKSDSRSGYETFRVVNGWTTANSKSQINRQVIVDSDSWSGYSGIFSVEGKNCINRCFYVELIRGRPQETRVWWTSNSIIVFCGTSGTYGTGSWPDGADINLMPI

SEQ ID NO: 23566 - protein, 469 aa, Artificial Sequence
  neuraminidase__InfluenzaA__AGQ81783
MNPNQKIVTIGSASLTIATMCLLLQIALFATTMTLHFKQTGCTNSSDNQAVPCGPIIIERNITEIVHLNSTTLEKETCPKSAGYRNWSKPQCQITGFAPFSKDNSIRLAAAGDIWVTREPYVSCGLGKCYQFALGQGTTLDNKHSNGTTHDRTPHRTLLMNELGVPFHLATKQVCIAWSSSSCHDGKAWLHVCVTGDDKNATASIIYNGILVDSIASWSKNILRTQESECVCINGTCTVVMTDGSASGRADTRILFIREGKIVHISPLSGSAQHVEECSCYPRYPEVRCVCRDNWKGSNRPVLFINMADYSIDSSYVCSGLVGDTPRNDDRSSSSNCRDPNNERGAPGVKGWAFDSGNDIWMGRTIEKDSRSGYETFRVISGWSTANSKSQINRQVIVDRDNSSGYSGIFSVEGKSCINRCFYVELIRGRPKENRVWWTSNSIIVFCGTSGTYGTGSWPDGANINLMPI

SEQ ID NO: 23567 - protein, 466 aa, Artificial Sequence
  neuraminidase__InfluenzaA__AGQ81784
MNPNQKIIAIGSVSLTIAIICFLMQIAILTTTMTLHFRQNECSNPSNNQVVPCEPIIIERNTVHLNSTTIEKEICPKVAEYKNWSKPQCQITGFAPFSKDNSIRLSAGGDIWVTREPYVSCSLGKCYQFALGQGTTLRNKHSNGTTHDRIPHRTLLMNELGVPFHLGTKQVCIAWSSSSCHDGKAWLHICVTGDDKNATASIIYDGMLVDSIGSWSKNILRTQESECVCINGTCAVVMTDGNASGKADTRVLFIREGKIINISPLSGSAQHVEECSCYPRYPEVRCVCRDNWKGSNRPVLYINMADYSIESSYVCSGLVGDTPRDDDSSSSSNCRDPNNERGAPGVKGWAFDDGNDIWMGRTIKSDSRSGYETFRVVNGWTTANSKSQINRQVIVDSDSWSGYSGIFSVEGKNCINRCFYVELIRGRPQETRVWWTSNSIIVFCGTSGTYGTGSWPDGADINFMPI

SEQ ID NO: 23568 - protein, 466 aa, Artificial Sequence
  neuraminidase__InfluenzaA__AGQ81785
MNPNQKIIAIGSVSLTIAIICFIMQIAILTTTMTPHFRQNECSNPSNNQVVPCEPIIIERNTVHLNSTTIEKEICPKVAEYKNWSKPQCQITGFAPFSKDNSIRLSAGGDIWVTREPYVSCSLGKCYQFALGQGTTLKNKHSNGTTHDRIPHRTLLMNELGVPFHLGTKQVCIAWSSSSCHDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSIESSYVCSGLVGDTPRDDDSSSSSNCRDPNNERGAPGVKGWAFDDGNDIWMGRTIKSDSRSGYETFRVVNGWTTANSKSQINRQVIVDSDSWSGYSGIFSVEGKNCINRCFYVELIRGRPQETRVWWTSNSIIVFCGTSGTYGTGSWPDGADINLMPI

SEQ ID NO: 23569 - protein, 466 aa, Artificial Sequence
  neuraminidase__InfluenzaA__AGQ81787
MNPNQKIIAIGSVSLIIAIICLLMQIAILTTTMTLHFRQNECSNPSNNQVVPCEPIIIERNTVHLNSTTIEREICPKVAEYKNWSKPQCQITGFAPFSKDNSIRLSAGGDIWVTREPYVSCSLDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 23570 - protein, 466 aa, Artificial Sequence
  neuraminidase__InfluenzaA__AGQ81789
MNPNQKIIAIGSVSLTIAIICLLMQIAILTTTMTPHFRQNECSNPSNNQVVPCEPIIIERNTVHLNSTTIEKEICPKVAEYKNWSKPQCQITGFAPFSKDNSIRLSAGGDIWVTREPYVSCSLGKCYQFALGQGTTLKNKHSNGTTHDRIPHRTLLMNELGVPFHLGTKQVCIAWSSSSCHDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSIESSYVCSGLVGDTPRDDDSSSSSNCRDPNNERGAPGVKGWAFDDGNDIWMGRTIKSDSRSGYETFRVVNGWTTANSKSQINRQVIVDSDSWSGYSGIFSVEGKNCINRCFYVELIRGRPQETRVWWTSNSIIVFCGTSGTYGTGSWPDGADINLMPI

SEQ ID NO: 23571 - protein, 466 aa, Artificial Sequence
  neuraminidase__InfluenzaA__AGQ81790
MNPNQKIIAIGSVSLIIAIICLLMQIAILTTTMTLHFRQNECSNPSNNQAMPCEPIIIERNTVHLNSTTIEREICPKVTEYKNWSKPQCQITGFAPFSKDNSIRLSAGGDIWVTREPYVSCSLDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGRADTRVLFIREGKIINISPLSGNAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTMANSKSQINRQVIVDSDEWSGYSGIFSVEGKKCINRCFYVELIRGRPQEPRVWWTSNSIIVFCGTSGTYGTGSWPDGANINFMPI

SEQ ID NO: 23572 - protein, 466 aa, Artificial Sequence
  neuraminidase__InfluenzaA__AGQ81792
MNPNQKIIAIGSVSLIIAIICLLMQIAILTTTMTLHFRQNECSNPSNNQVMPCEPIIIERNTVHLNSTTIEREICPKVAEYKNWSKPQCQITGFAPFSKDNSIRLSAGGDIWVTREPYVSCSLNKCYQFALGQGTTLENKHSNGTTHDRTPHRTLLMNELGVPFHLGTKQVCMAWSSSSCYDGKAWLHICVTGDDKNATASVIYDGMLVDSIGSWSQNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 23573 - protein, 466 aa, Artificial Sequence
  neuraminidase__InfluenzaA__AGQ81793
MNPNQKIIAIGSVSLIIAIICLLMQIAILTTTMTLHFRQNECSNPSNNQVMPCEPIIIERNTVHLNSTTIEREICPKVAEYKNWSKPQCQITGFAPFSKDNSIRLSAGGDIWVTREPYVSCSLNKCYQFALGQGTTLENKHSNGTTHDRTPHRTLLMNELGVPFHLGTKQVCMAWSSSSCYDGKAWLHICVTGDDKNATASVIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 23574 - protein, 466 aa, Artificial Sequence; identical to SEQ ID NO: 23573
  neuraminidase__InfluenzaA__AGQ81794

SEQ ID NO: 23575 - protein, 466 aa, Artificial Sequence
  neuraminidase__InfluenzaA__AGQ81795
MNPNQKIIAIGSVSLIIAIICLLMQIAILTTTMTLHFRQNECNNPSNNQVMPCEPIIIERNTVHLNSTTIEREICPKVAEYKNWSKPQCQITGFAPFSKDNSIRLSAGGDIWVTREPYVSCSLDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTIANSKSQINRQIIVDSDDWSGYSGIFSVEGKKCINRCFYVELIRGRPQEPRVWWTSNSIIVFCGTSGTYGTGSWPDGANINFMPI

SEQ ID NO: 23576 - protein, 466 aa, Artificial Sequence
  neuraminidase__InfluenzaA__AGQ81796
MNPNQKIIAIGSVSLIIAIICLLMQIAILTTTMTLHFRQNECSNPSNNQVMPCEPIIIERNTVHLNSTTIEREICPKVAEYKNWSKPQCQITGFAPFSKDNSIRLSAGGDIWVTREPYVSCSLDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDIWMGRTIKNGSRSGYETFRVVNGWTMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 23577 - protein, 466 aa, Artificial Sequence
  neuraminidase__InfluenzaA__AGQ81798
MNPNQKIISIGSVSLIIAIICLLMQIAILTTTMTLHFRQNECSNPSNNQVMPCEPIIIERNTVHLNSTTIEREICPKVAEYKNWSKPQCQITGFAPFSKDNSIRLSAGGDIWVTREPYVSCSLDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 23578 - protein, 466 aa, Artificial Sequence
  neuraminidase__InfluenzaA__AGQ81799
MNPNQKIIAIGSVSLIIAIICLLMQIAILTTTMTLHFRQNECSNPSNNQVMPCEPIIIERNTVHLNSTTIEREICPKVAEYKNWSKPQCQITGFAPFSKDNSIRLSAGGDIWVTREPYVSCSLDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 23579 - protein, 466 aa, Artificial Sequence; identical to SEQ ID NO: 23578
  neuraminidase__InfluenzaA__AGQ81800

SEQ ID NO: 23580 - protein, 466 aa, Artificial Sequence
  neuraminidase__InfluenzaA__AGQ81801
MNPNQKIIAIGSVSLIIAIICLLMQIAILTTTMTLHFRQNECSNPSNNQVMPCEPIIIERNTVHLNSTTIEREICPKVAEYKNWSKPQCQITGFAPFSKDNSIRLSASGDIWVTREPYVSCSLDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 23581 - protein, 466 aa, Artificial Sequence
  neuraminidase__InfluenzaA__AGQ81802
MNPNQKIIAIGSVSLIIAIICLLMQIALLTTTMTLHFRQNECSNPSNNQVMPCEPIIIERNTVHLNSTTIEREICPKVAEYKNWSKPQCQITGFAPFSKDNSIRLSAGGDIWVTREPYVSCSLDKCYQFALGQGTTLKNKHSNGTTHDRTPHRTLLMNELGVPFHLGTKQVCIAWSSSSCYDGKAWLHICVTGDDKNATASIIYNGMLVDSIGSWSKNILRTQESECVCINGTCAVVMTDGSASGKADTRVLFIREGEIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWTMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 23582 - protein, 466 aa, Artificial Sequence
  neuraminidase__InfluenzaA__AGQ81803
MNPNQKIIAIGSVSLIIAIICLLMQIAILTTTMTLHFRQNECSNPSNNQVMPCEPIIIERNTVHLNSTTIEREICPKVAEYKNWSKPQCQITGFAPFSKDNSIRLSASGDIWVTREPYVSCSLDKCYQFALGQGTTLKNEHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWIMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 23583 - protein, 469 aa, Artificial Sequence
  neuraminidase__InfluenzaA__AGQ81804
MNPNQKMIAIGAVSLTIAIICLLMQTAILVTTMTLHFKHNECTNSSNNQAAPCGPIIIERNVTEVVHLNSTTLEKEICPKAAGYRNWSKPQCQITGFAPFSKDNSIRLSAGGDIWVTREPYVSCGLGKCYQFALGQGTTLDNSHSNGTSHDRTPHRTLLMNELGVPFHLMTKQVCIAWSSSSCHDGKAWLHVCVTGDDRNATASIIYGGILVDSIGSWSKNILRTQESECVCINGTCAVVMTDGSASGKADTRILFIREGKIVHISPLSGSAQHVEECSCYPQYPEVRCVCRDNWRGSNRPVLYINMADYSIDSGYVCSGLVGDTPRNDDVSSSSNCKDPNNERGAPGVKGWAFDNGNDIWMGRTIDKDSRSGYETFRVIDGWNTANSKSQTSRQVIVGSDNSSGYSGIFSVEGKSCINRCFYVELIRGRPKETRVWWTSNSIIVFCGTSGTYGTGSWPDGANINFMPI

SEQ ID NO: 23584 - protein, 466 aa, Artificial Sequence
  neuraminidase__InfluenzaA__AGQ81805
MNPNQKIIAIGSVSLIIAIICLLMQIALLTTTMTLHFRQNECSNPSNNQVMPCEPIIIERNTVHLNSTTIEREICPKVAEYKNWSKPQCQITGFAPFSKDNSIRLSAGGDIWVTREPYVSCSLDKCYQFALGQGTTMKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRVLFIREGKIINISPLSGSAQHVEECSCYPRYPEVRCVCRDNWKGSNRPILYINMADYSIESSYVCSGLVGDTPRNDDSSSSSNCRGPNNERGAPGVKGWAFDDGNDVWMGRTIKNGSRSGYETFRVVNGWTMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 23585 - protein, 466 aa, Artificial Sequence
  neuraminidase__InfluenzaA__AGQ81807
MNPNQKITAIGSISLIIAIICLLMQIAILTTTMTLHFRQNECRNPSNNQVMPCEPVIIERNTVHLNSTTIEREICPKVAEYKNWSKPQCQITGFAPFSKDNSIRLSASGDIWVTREPYVSCSLNKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRVLFIKEGKIINISPLSGSAQHVEECSCYPRYPEVRCVCRDNWKGSNRPILYINMADYSIESSYVCSGLVGDTPRNDDSSSSSNCRDPNNERGAPGVKGWAFDDGNDVWMGRTIKNGSRSGYETFRVVNGWIMANSKSQINRQVIVDSDDWSGYSGIFSVEGKKCINRCFYVELIRGRPQEPRVWWTSNSIIVFCGTSGTYGTGSWPDGANINFMPI

SEQ ID NO: 23586 - protein, 466 aa, Artificial Sequence
  neuraminidase__InfluenzaA__AGQ81808
MNPNQKIIAIGSVSLTIAIICFLMQIAILTTTMTLHFKQNECSNPSNNQVVPCEPILIERNTVHLNSTTIEKEVCPKVAEYKNWSKPQCQITGFAPFSKDNSIRLSAGGDIWVTREPYVSCSLGKCYQFALGQGTTLKNNHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSVESSYVCSGLVGDTPRNDDSSSSSNCRDPNNERGAPGVKGWAFDDGNDVWMGRTIRNNSRSGYETFRVVNGWTTANSKSQINRQIIVDSENWSGYSGIFSVEGKNCINRCFYVELIRGRPQEPRVWWTSNSIIVFCGTSGTYGTGSWPDGANINFMPI

SEQ ID NO: 23587 - protein, 466 aa, Artificial Sequence
  neuraminidase__InfluenzaA__AGQ81809
MNPNQKITAIGSVSLIIAIICLLMQIAILTTTMTLHFRQNECSNPSNNQVMPCEPIIIERNTVHLNSTTIEREICPKVAEYKNWSKPQCQITGFAPFSKDNSIRLSAGGDIWVTREPYVSCSPDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGEADTRILFIREGKIINISPLSGSAQHVEECSCYPRYPEVRCVCRDNWKGSNRPIIYINMVDYSIGSRYVCSGLVGDTPRNDDSTSSSNCRDPNNERGAPGVKGWAFDDGNDVWMGRTIKNGSRSGYETFRVINGWTMANSKSQINRQVIVDSDNWSGYSGIFSVEGKKCINRCFYVELIRGRPQEPRVWWTSNSIIVFCGTSGTYGTGSWPDGADINFMPI

SEQ ID NO: 23588 - protein, 466 aa, Artificial Sequence
  neuraminidase__InfluenzaA__AGQ81810
MNPNQKILAIGSVSLTIAIICFLMQIAILTTTMTLHFKQNECSNPSNNQVVPCEPILIERNTVHLNSTTIEKEVCPKVAEYKNWSKPQCQITGFAPFSKDNSIRLSAGGDIWVTREPYVSCSLGKCYQFALGQGTTLKNNHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSIESSYVCSGLVGDTPRNDDSSSSSNCRDPNNERGAPGVKGWAFDDGNDVWMGRTIRNNSRSGYETFRVVNGWTTANSKSQINRQVIVDSENWSGYSGIFSVEGKNCINRCFYVELIRGRPQEPRVWWTSNSIIVFCGTSGTYGTGSWPDGANINFMPI

SEQ ID NO: 23589 - protein, 466 aa, Artificial Sequence
  neuraminidase__InfluenzaA__AGQ81811
MNPNQKIIAIGSVSLTIAIICFLMQIAILTTTMTLHFKQNECSNPSNNQVVPCEPILIERNTVHLNSTTIEKEVCPKVAEYKNWSKPQCQITGFAPFSKDNSIRLSAGGDIWVTREPYVSCSLGKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRILFIREGKIVNISPLSGSAQHVEECSCYPRYPEVRCVCRDNWKGSNRPVLYINMADYSVESSYVCSGLVGDTPRNDDSFSSSNCRDPNNERGAPGVKGWAFDDGNDVWMGRTIRNDSRSGYETFRVVNGWTTANSKSQINRQVIVDSESWSGYSGIFSVEGKNCINRCFYVELIRGRPQEPRVWWTSNSIIVFCGTSGTYGTGSWPDGANINFMPI

SEQ ID NO: 23590 - protein, 469 aa, Artificial Sequence
  neuraminidase__InfluenzaA__AGQ81812
MNPNQKIITIGSVSLTIATICFLMQIAILVTTITLHFKQNECSIPSNNQVVPCEPIIVERNITEIVYLNNTTIEKELCPKLTEYRDWSKPQCQITGFAPFSKDNSIRLSAGGDIWVTREPYVSCSPNKCYQFALGQGTTLDNKHSNGTIHDRIPHRTLLMNELGVPFHLGTKQVCIAWSSSSCHDGKAWLHVCVTGDDRNATASFIYDGMLVDSIGSWSQNILRTQESECVCINGTCTVVMTDGSASGRADTRILFIKEGKIVHVSPLSGSAQHIEECSCYPRYPDVRCVCRDNWKGSNRPIIDINVADYSIDSSYVCSGLVGDTPRNDDSSSNSNCKDPNNERGNPGVKGWAFDYGNDVWMGRTISKDSRSGYETFRVIGGWTTANSKSQVNRQVIVDNNNWSGYSGIFSVEGKSCINRCFYVELIRGRPQETRVWWTSNSIVVFCGTSGTYGTGSWPDGANINFMPI

SEQ ID NO: 23591 - protein, 466 aa, Artificial Sequence
  neuraminidase__InfluenzaA__AGQ81814
MNPNQKIIAIGSVSLTIAIMCFLMQIAILTTTMTLHFKQNECSNPSNNQVVPCEPILIERNTVHLNSTTIEKEVCPKVAEYKNWSKPQCQITGFAPFSKDNSIRLSAGGDIWVTREPYVSCSLGKCYQFALGQGTTLKNNHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSVESSYVCSGLVGDTPRNDDSSSSSNCRDPNNERGAPGVKGWAFDDGNDVWMGRTIRNNSRSGYETFRVVNGWTTANSKSQINRQVIVDSENWSGYSGIFSVEGKNCINRCFYVELIRGRPQEPRVWWTSNSIIVFCGTSGTYGTGSWPDGANINFMPI

SEQ ID NO: 23592 - protein, 466 aa, Artificial Sequence
  neuraminidase__InfluenzaA__AGQ81815
MNPNQKIIAIGSVSLTIAIICFLMQIAILTTTMTLHFKQNECSNPSNNQVVPCEPILIERNTVHLNSTTIEKEVCPKVAEYKNWSKPQCQITGFAPFSKDNSIRLSAGGDIWVTREPYVSCSLGKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSVESSYVCSGLVGDTPRNDDSSSSSNCRDPNNERGTPGVKGWAFDDGNDVWMGRTIRNDSRSGYETFRVINGWTTANSKSQINRQVIVDSENWSGYSGIFSVEGKNCINRCFYVELIRGRPQEPRVWWTSNSIIVFCGTSGTYGTGSWPDGANINYMPI

SEQ ID NO: 23593 - protein, 466 aa, Artificial Sequence
  neuraminidase__InfluenzaA__AGQ81816
MNPNQKIIAIGSVSLTIAIICFLMQIAILTTTMTLHFKQNGCSNPSNNQVVPCEPILIERNTVHLNSTTIEKEVCPKVAEYKNWSKPQCQITGFAPFSKDNSIRLSAGGDIWVTREPYVSCSLGKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSVESSYVCSGLVGDTPRNDDSSSSSNCRDPNNERGTPGVKGWAFDDGNDVWMGRTIRNDSRSGYETFRVINGWTTANSKSQINRQVIVDSENWSGYSGIFSVEGKNCINRCFYVELIRGRPQEPRVWWTSNSIIVFCGTSGTYGTGSWPDGANINYMPI

SEQ ID NO: 23594 - protein, 466 aa, Artificial Sequence; identical to SEQ ID NO: 23592
  neuraminidase__InfluenzaA__AGQ81817

SEQ ID NO: 23595 - protein, 466 aa, Artificial Sequence; identical to SEQ ID NO: 23592
  neuraminidase__InfluenzaA__AGQ81818

SEQ ID NO: 23596 - protein, 466 aa, Artificial Sequence; identical to SEQ ID NO: 23592
  neuraminidase__InfluenzaA__AGQ81819

SEQ ID NO: 23597 - protein, 466 aa, Artificial Sequence
  neuraminidase__InfluenzaA__AGQ81820
MNPNQKIIAIGSVSLTIAIICFLMQIAILTTTMTLHFKQNECSNPSNNQVVPCEPILIERNTVHLNSTTIEKEVCPKVAEYKNWSKPQCQITGFAPFSKDNSIRLSAGGDIWVTREPYVSCSLGKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSIESSYVCSGLVGDTPRNDDSSSSSNCRDPNNERGTPGVKGWAFDDGNDVWMGRTIRNDSRSGYETFRVINGWTTANSKSQINRQVIVDSENWSGYSGIFSVEGKNCINRCFYVELIRGRPQEPKVWWTSNSIIVFCGTSGTYGTGSWPDGANINFMPI

SEQ ID NO: 23598 - protein, 466 aa, Artificial Sequence
  neuraminidase__InfluenzaA__AGQ81822
MNPNQKIIAIGSVSLTIAIICFLMQIAILTTTMTLHFKQNECSNPSNNQVVPCEPILIERNTVHLNSTTIEKKVCPKVAEYKNWSKPQCQITGFAPFSKDNSIRLSAGGDIWVTREPYVSCSLGKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSVESSYVCSGLVGDTPRNDDSSSSSNCRDPNNERGTPGVKGWAFDDGNDVWMGRTIRNDSRSGYETFRVINGWTTANSKSQINRQVIVDSENWSGYSGIFSVEGKNCINRCFYVELIRGRPQEPRVWWTSNSIIVFCGTSGTYGTGSWPDGANINYMPI

SEQ ID NO: 23599 - protein, 466 aa, Artificial Sequence
  neuraminidase__InfluenzaA__AGQ81823
MNPNQKIIAIGSVSLTIAIICFLMQIAILTTTMTLHFKQNECSNPSNNQVVPCEPILIERNTVHLNSTTIEKEVCPKVAEYKNWSKPQCQITGFAPFSKDNSIRLSAGGDIWVTREPYVSCSLGKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSVESSYVCSGLVGDTPRNDDSSSSSNCRDPNNERGAPGVKGWAFDDGNDVWMGRTIRNDSRSGYETFRVVNGWTTANSKSQINRQVIVDSENWSGYSGIFSVEGKNCINRCFYVELIRGRPQEPRVWWTSNSIIVFCGTSGTYGTGSWPDGANINFMPI

SEQ ID NO: 23600 - protein, 466 aa, Artificial Sequence; identical to SEQ ID NO: 23599
  neuraminidase__InfluenzaA__AGQ81824

SEQ ID NO: 23601 - protein, 466 aa, Artificial Sequence; identical to SEQ ID NO: 23599
  neuraminidase__InfluenzaA__AGQ81825

SEQ ID NO: 23602 - protein, 466 aa, Artificial Sequence
  neuraminidase__InfluenzaA__AGQ81831
MNPNQKILAIGSVSLTIAIICFLMQIAILTTTMTLHFKQNECSNPSNNQVVPCEPILIERNTVHLNSTTIEKEVCPKVAEYKNWSKPQCQITGFAPFSKDNSIRLSAGGDIWVTREPYVSCSLGKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRILFIREGKIVNISPLSGSAQHVEECSCYPRYPEVRCVCRDNWKGSNRPVLYINMADYSVESSYVCSGLVGDTPRNDDSFSSSNCRDPNNERGAPGVKGWAFDDGNDVWMGRTIRNDSRSGYETFRVVNGWTTANSKSQINRQVIVDSESWSGYSGIFSVEGKNCINRCFYVELIRGRPQEPRVWWTSNSIIVFCGTSGTYGTGSWPDGANINFMPI

SEQ ID NO: 23603 - protein, 466 aa, Artificial Sequence; identical to SEQ ID NO: 23592
  neuraminidase__InfluenzaA__AGQ81837

SEQ ID NO: 23604 - protein, 466 aa, Artificial Sequence; identical to SEQ ID NO: 23592
  neuraminidase__InfluenzaA__AGQ81838

SEQ ID NO: 23605 - protein, 466 aa, Artificial Sequence; identical to SEQ ID NO: 23599
  neuraminidase__InfluenzaA__AGQ81839

SEQ ID NO: 23606 - protein, 466 aa, Artificial Sequence; identical to SEQ ID NO: 23599
  neuraminidase__InfluenzaA__AGQ81840

SEQ ID NO: 23607 - protein, 466 aa, Artificial Sequence; identical to SEQ ID NO: 23592
  neuraminidase__InfluenzaA__AGQ81841

SEQ ID NO: 23608 - protein, 469 aa, Artificial Sequence
  neuraminidase__InfluenzaA__AGQ81843
MNPNQKIITIGVVNTTLSTIALLIGIGNLIFNTVIHEKIGVHQTVVYPTITPPVIPNCSDTTITYNNTVVNNITTTIINKAEKQFKPSLPLCPFRGFFPFHKDNAIRLGENKDVIVTREPYVSCDNDDCWSFALAQGALLGTKHSNGTIKDRTPYRSLIRFPIGTAPVLGNYKEICVAWSSSSCFDGKEWMHVCMTGNDNDASGQIIYAGKMTDSIKSWRRDILRTQESECQCIDGTCIVAVTDGPAASSADHRIYWIREGKIIKYEDIPKTKIQHLEECSCYVDTDVYCICRDNWKGSNRPWMRINNETILETGYVCSKFHSDTPRPADPSTVSCDSPSNINGGPGVKGFGFRAGNDVWLGRTVSTTGRSGFEVIKVTEGWINSLNHAKSVTQTLVSNNDWSGYSGSFIVENNGCFQPCFYIELIRGRPNRNDDVSWTSNSIVTFCGLDNEPGSGNWPDGSNIGFMPK

SEQ ID NO: 23609 - protein, 469 aa, Artificial Sequence
  neuraminidase__InfluenzaA__AGQ81845
MNPNQKIITIGVVNTTLSTIALLIGIGNLIFNTVIHEKIGVHQTVIYPTITSPVVPNCSDTTITYNNTVVNNITTTVINKAEKHFKPSLPLCPFKGFFPFHKDNAIRLGENKDVIVTREPYVSCDNDDCWSFALAQGALLGTKHSNGTIKDRTPYRSLIRFPIGTAPVLGNYKEICVAWSSSSCFDGKEWMHVCMTGNDNDASGQIIYAGKMTDSIKSWRRDILRTQESECQCIDGTCIVAVTDGPAANSADHRIYWIREGKIIKYENIPKTKIQHLEECSCYVDTDVYCICRDNWKGSNRPWMRINNETILETGYVCSKFHSDTPRPADPSTVSCDSPSNINGGPGVKGFGFRTGNDVWLGRTVSTTGRSGFEVIKVTEGWINSLNHAKSVTQTLVSNSDWSGYSGSFIVENNGCFQPCFYIELIRGRPNKNDDVSWTSNSIVTFCGLDNEPGSGNWPDGSNIGFMPK

SEQ ID NO: 23610 - protein, 469 aa, Artificial Sequence; identical to SEQ ID NO: 23609
  neuraminidase__InfluenzaA__AGQ81846

SEQ ID NO: 23611 - protein, 469 aa, Artificial Sequence; identical to SEQ ID NO: 23609
  neuraminidase__InfluenzaA__AGQ81847

SEQ ID NO: 23612 - protein, 469 aa, Artificial Sequence
  neuraminidase__InfluenzaA__AGQ81848
MNPNQKIITIGVVNTTLSTIALLIGIGNLIFNTVIHEKIGVHQTVIYPTITSPVVPNCSDTTITYNNTVVNNITTTVINKAEKHFKPSLPLCPFKGFFPFHKDNAIRLGENKDVIVTREPYVSCDNDDCWSFALAQGALLGTKHSNGTIKDRTPYRSLIRFPIGTAPVLGNYKEICVAWSSSSCFDGKEWMHVCMTGNDNDASGQIIYAGKMTDSIKSWRRDILRTQESECQCIDGICIVAVTDGPAANSADHRIYWIREGKIIKYENIPKTKIQHLEECSCYVDTDVYCICRDNWKGSNRPWMRINNETILETGYVCSKFHSDTPRPADPSTVSCDSPSNINGGPGVKGFGFRTGNDVWLGRTVSTTGRSGFEVIKVTEGWINSLNHAKSVTQTLVSNSDWSGYSGSFIVENNGCFQPCFYIELIRGRPNKNDDVSWTSNSIVTFCGLDNEPGSGNWPDGSNIGFMPK

SEQ ID NO: 23613 - protein, 469 aa, Artificial Sequence
  neuraminidase__InfluenzaA__AGQ81850
MNPNQKIITIGVVNTTLSTIALLIGIGNLIFNTVIHEKIGVHQTVIYPTITSPVVPNCSDTTITYNNTVVNNITTTVINKAEKHFKPSLPLCPFKGFFPFHKDNAIRLGENKDVIVTREPYVSCDNDDCWSFALAQGALLGTKHSNGTIKDRTPYRSLIRFPIGTAPVLGNYKEICVAWSSSSCFDGKEWMHVCMTGNDNDATGQIIYAGKMTDSIKSWRRDILRTQESECQCIDGTCIVAVTDGPAANSADHRIYWIREGKIIKYENIPKTKIQHLEECSCYVDTDVYCICRDNWKGSNRPWMRINNETILETGYVCSKFHSDTPRPADPSTVSCDSPSNINGGPGVKGFGFRTGNDVWLGRTVSTTGRSGFEVIKVTEGWINSLNHAKSVTQTLVSNSDWSGYSGSFIVENNGCFQPCFYIELIRGRPNKNDDVSWTSNSIVTFCGLDNEPGSGNWPDGSNIGFMPK

SEQ ID NO: 23614 - protein, 469 aa, Artificial Sequence
  neuraminidase__InfluenzaA__AGQ81852
MNPNQKIITIGVVNTTLSTIALLIGIGNLIFNTVIHEKIGVHQTVTYPTITSPVVPNCSDTTITYNNTVVNNITTTVINKAEKHFKPSLPLCPFKGFFPFHKDNAIRLGENKDVIVTREPYVSCDNDDCWSFALAQGALLGTKHSNGTIKDRTPYRSLIRFPIGTAPVLGNYKEICVAWSSSSCFDGKEWMHVCMTGNDNDATGQIIYAGKMTDSIKSWRRDILRTQESECQCIDGTCIVAVTDGPAANSADHRIYWIREGKIIKYENIPKTKIQHLEECSCYVDTDVYCICRDNWKGSNRPWMRINNETILETGYVCSKFHSDTPRPADPSTVSCDSPSNINGGPGVKGFGFRTGNDVWLGRTVSTTGRSGFEVIKVTEGWINSLNHAKSVTQTLVSNSDWSGYSGSFIVENNGCFQPCFYIELIRGRPNRNDDVSWTSNSIVTFCGLDNEPGSGNWPDGSNIGFMPK

SEQ ID NO: 23615 - protein, 469 aa, Artificial Sequence
  neuraminidase__InfluenzaA__AGQ81853
MNPNQKIITIGVVNTTLSTIALLIGIGNLIFNTVIHEKIGVHQTVTYPTITSPVVPNCSDTTITYNNTVVNNITTTVINKAEKHFKPSLPLCPFKGFFPFHKDNAIRLGENKDVIVTREPYVSCDNDDCWSFALAQGALLGTKHSNGTIKDRTPYRSLIRFPIGTAPVLGNYKEICVAWSSSSCFDGKEWMHVCMTGNDNDATGQIIYAGKMTDSIKSWRRDILRTQESECQCIDGTCIVAVTDGPAANSADHRIYWIREGKIIKYENIPKTKIQHLEECSCYVDTDVYCICRDNWKGSNRPWMRINNETILETGYVCSKFHSDTPRPADPSTVSCDSPSNINGGPGVKGFGFRTGNDVWLGRTVSTTGRSGFEVIKVTEGWINSLNHAKSVTQTLVSNSDWSGYSGSFIVENNGCFQPCFYIELIRGRPNKNDDVSWTSNSIVTFCGLDNEPGSGNWPDGSNIGFMPK

SEQ ID NO: 23616 - protein, 469 aa, Artificial Sequence; identical to SEQ ID NO: 23615
  neuraminidase__InfluenzaA__AGQ81854

SEQ ID NO: 23617 - protein, 469 aa, Artificial Sequence; identical to SEQ ID NO: 23615
  neuraminidase__InfluenzaA__AGQ81855

SEQ ID NO: 23618 - protein, 469 aa, Artificial Sequence; identical to SEQ ID NO: 23608
  neuraminidase__InfluenzaA__AGQ81856

SEQ ID NO: 23619 - protein, 469 aa, Artificial Sequence
  neuraminidase__InfluenzaA__AGQ81857
MNPNQKIITIGVVNTTLSTIALLIGIGNLIFNTVIHEKIGVHQTVVYPTITPPVIPNCSDTTITYNNTVVNNITTTIINKAEKQFKPSLPLCPFRGFFPFHKDNAIRLGENKDVIVTREPYVSCDNDDCWSFALAQGALLGTKHSNGTIKDRTPYRSLIRFPIGTAPVLGNYKEICVAWSSSSCFDGKEWMHVCMTGNDNDASGQIIYAGKMTDSIKSWRRDILRTQESECQCIDGTCIVAVTDGPAASSADHRIYWIREGKIIKYEDIPKTKIQHLEECSCYVDTDVYCICRDNWKGSNRPWMRINNETILETGYVCSKFHSDTPRPADPSTVSCDSPSNINGGPGVKGFGFRAGNDVWLGRTVSTTGRSGFEVIKVTEGWINSLNHAKSVTQTLVSNNDWSGYSGSFIVESNGCFQPCFYIELIRGRPNRNDDVSWTSNSIVTFCGLDNEPGSGNWPDGSNIGFMPK

SEQ ID NO: 23620 - protein, 469 aa, Artificial Sequence
  neuraminidase__InfluenzaA__AGQ81858
MNPNQKIITIGVVNTTLSTIALLIGVGNLIFNTVIHEKIGDHQIVVYPTTTASVVPNCSDTIITYNNTVVNNITTTIITKEETHFKSSLPLCPFRGFFPFHKDNAIRLGENKDVIVTREPYVSCDNDDCWSFALAQGALLGTKHSNGTIKDRTPYRSLIRFPIGTAPVLGNYKEICVAWSSSSCFDGKEWMHVCMTGNDNDASGQIMYAGKMTDSIKSWRKDILRTQESECQCIDGTCIVAVTDGPATNSADHRIYWIREGKIIKYENIPKTKIQHLEECSCYVDIDVYCVCRDNWKGSNRPWMRINNETILETGYVCSKFHSDTPRPADPSTVSCDSPSNVNGGPGVKGFGFKTGNDVWLGRTVSTSGRSGFEIIKVTEGWINSPNHAKSVTQTLVSNNDWSGYSGSFIVENNGCFQPCFYIELIRGRPNKNDDVSWTSNSIVTFCGLDNEPGSGNWPDGSNIGFMPK

SEQ ID NO: 23621 - protein, 469 aa, Artificial Sequence
  neuraminidase__InfluenzaA__AGQ81859
MNPNQKIITIGVVNTTLSTIALLIGIGNLIFNTVIHEKIGVHQTVVCPTITPPVVPNCSDTTITYNNTVVNNITTTIINKAEKQFKSSLPLCPFRGFFPFHKDNAIRLGENKDVIVTREPYVSCDNDDCWSFALAQGALLGTKHSNGTIKDRTPYRSLIRFPIGTAPVLGNYKEICVAWSSSSCFDGKEWMHICMTGNDNDASGQIIYAGKMTDSIKSWRRDILRTQESECQCIDGTCIVAITDGPAASSADHRIYWIREGKIIKYENIPKTKIQHLEECSCYVDIDVYCICRDNWKGSNRPWMRINNETILETGYVCSKFHSDTPRPADPSTVSCDSPSNINGGPGVKGFGFRAGNDVWLGRTVSTTGRSGFEVIKVTEGWINSLNHAKSVTQTLVSNSDWSGYSGSFIVENNGCFQPCFYIELIRGRPNRNDDVSWTSNSIVTFCGLDNEPGSGNWPDGSNIGFMPK

SEQ ID NO: 23622 - protein, 470 aa, Artificial Sequence
  neuraminidase__InfluenzaA__AGQ81860
MNPNQKIICISATGMTLSVVSLLIGIANLGLNIGLHYKVGDTPDVSIPNMNETNSTTTIINNNTQNNFTNITNIIVNKNEEKTFLNLTKPLCEVNSWHILSKDNAIRIGEDAHILVTREPYLSCDPQGCRMFALSQGTTLRGRHANGTIHDRSPFRALVSWEMGQAPSPYNVKVECVGWSSTSCHDGISRMSICMSGPNNNASAVVWYGGRPVTEIPSWAGNILRTQESECVCHKGICPVVMTDGPANNRAATKIIYFKEGKIQKIEELAGSAQHIEECSCYGAVEVIKCICRDNWKGANRPVITINPEMMTHTSKYLCSKVLTDTSRPNDPTNGNCDAPITGGSPDPGVKGFAFLDGENSWLGRTISKDSRSGYEMLKVPNAETDTQSGPTSHQVIVNNQNWSGYSGAFIDYWANKECFNPCFYVELIRGRPKESSVLWTSNSIVALCGSKERLGSWSWHDGAEIIYFK

SEQ ID NO: 23623 - protein, 470 aa, Artificial Sequence
  neuraminidase__InfluenzaA__AGQ81861
MNPNQKIICISATGMTLSVVSLLIGIANLGLNIGLHYKVGDTPDVSIPNMNETNSTTTIINNNTQNNFTNTTNIIVNKNEEKTFLNLTKPLCEVNSWHILSKDNAIRIGEDAHILVTREPYLSCDPQGCRMFALSQGTTLRGRHANGTIHDRSPFRALVSWEMGQAPSPYNVKVECVGWSSTSCHDGISRMSICMSGPNNNASAVVWYGGRPVTEIPSWAGNILRTQESECVCHKGICPVVMTDGPANNRAATKIIYFKEGKIQKIEELAGSAQHIEECSCYGAVEVIKCICRDNWKGANRPVITINPEMMTHTSKYLCSKVLTDTSRPNDPTNGNCDAPITGGSPDPGVKGFAFLDGENSWLGRTISKDSRSGYEMLKVPNAETDTQSGPTSHQVIVNNQNWSGYSGAFIDYWANKECFNPCFYVELIRGRPKESSVLWTSNSIVALCGSKERLGSWSWHDGAEIIYFK

SEQ ID NO: 23624 - protein, 470 aa, Artificial Sequence
  neuraminidase__InfluenzaA__AGQ81862
MNPNQKIICISATGMTLSVVSLLIGIANLGLNIGLHYKVGDTPDVNIPSMNETNSTTTIINNNTQNNFTNITNIIVNKEEGRTFLNLTKPLCEVNSWHILSKDNAIRIGEDAHILVTREPYLSCDPQGCRMFALSQGTTLRGRHANGTIHDRSPFRALVSWEMGQAPSPYNVRVECIGWSSTSCHDGISRMSICMSGPNNNASAVVWYGGRPVTEIPSWAGNILRTQESECVCHKGICPVVMTDGPANNRAATKIIYFKEGKIQKIEELEGNAQHIEECSCYGAAGVIKCICRDNWKGANRPVIIIDPEMMTHTSKYLCSRVLTDTSRPNDPTSGNCDAPITGGSPDPGVKGFAFLDGENSWLGRTISKDSRSGYEMLKVPNAETDTQSGPTSHQVIVNNQNWSGYSGAFIDYWANKECFNPCFYVELIRGRPKESSVLWTSNSIVALCGSKERLGSWSWHDGAEIIYFK

SEQ ID NO: 23625 - protein, 470 aa, Artificial Sequence
  neuraminidase__InfluenzaA__AGQ81863
MNPNQKIICISATGMTLSVVSLLIGIANLGLNIGLHYKVGDTPDVNIPSMNETNSTTTIINNNTQNNFTNITNIIVNKEEERTFLNLTKPLCEVNSWHILSKDNAIRIGEDAHILVTREPYLSCDPQGCRMFALSQGTTLRGRHANGTIHDRSPFRALVSWEMGQAPSPYNVRVECIGWSSTSCHDGISRMSICMSGPNNNASAVVWYGGRPVTEIPSWAGNILRTQESECVCHKGICPVVMTDGPANNRAATKIIYFKEGKIQKIEELEGNAQHIEECSCYGAAGVIKCICRDNWKGANRPVIIIDPEMMTHTSKYLCSRVLTDTSRPNDPISGNCDAPITGGSPDPGVKGFAFLDGENSWLGRTISKDSRSGYEMLKVPNAETDTQSGPTSHQVIVNNQNWSGYSGAFIDYWANKECFNPCFYVELIRGRPKESSVLWTSNSIVALCGSKERLGSWSWHDGAEIIYFK

SEQ ID NO: 23626 - protein, 471 aa, Artificial Sequence
  neuraminidase__InfluenzaA__AGQ81864
MNPNQKLFALSGVAIALSVLNLLIGISNVGLNVSLHLKEKGPKQEENSTCTTINQNNTTIVENTYVNNTTIISKETELKPPNYLLLNKSLCNVEGWVVIAKDNAVRFGESEQIIVTREPYVSCDPTGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASSQAYTKVMYFHKGLVIKEEALKGSARHIEECSCYGHSQKATCVCRDNWQGANRPIIEIDMNTLEHTSRYVCTGILTDTSRPGDKSSGDCSNPITGSPGAPGVKGFGFLNGDNTWLGRTISPKSRSGFEMLKIPNAGTDPNSRIAERQEIVDNNNWSGYSGSFIDYWDNDSECYNPCFYVELIRGRPEEAKYVWWTSNSLIALCGSPFPVGSGSFPDGAQIQYFS

SEQ ID NO: 23627 - protein, 471 aa, Artificial Sequence
  neuraminidase__InfluenzaA__AGQ81865
MNPNQKLFALSGVAIALSVLNLLIGLSNVGLNVSLHLKETGPKQEGNLTCMTINQNNTTVVENTYVNNTTIITKETESETPNYLLLNKSLCNVEGWVVIAKDNAVRFGESEQIIVTREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASSQAHTKVMYFHKGLVVKEEALKGSARHIEECSCYGHNQKVTCVCRDNWQGANRPIIEIDMNTLEHTSRYVCTGILTDTSRPGDKPTGDCSNPITGSPGAPGVKGFGFLNGGNTWLGRTISPRSRSGFEMLKIPNAGTDPNSRIAERQEIVDNSNWSGYSGSFIDYWNDNSECYNPCFYVELIRGRPEEAKYVWWTSNSLIALCGSPFPVGSGSFPDGAQIQYFS

SEQ ID NO: 23628 - protein, 471 aa, Artificial Sequence
  neuraminidase__InfluenzaA__AGQ81868
MNPNQKLFALSGVAIALSVLNLLIGISNVGLNVSLHLKEKGPKQEENSTCTTINQNNTTVVENTYVNNTTIITKETELKTPSYLLLNKSLCNVEGWVVIAKDNAVRFGESEQIIVTREPYVSCDPTGCKMYALHQGTTIRNKHSNGTIHDRTAFRGLISTSLGTPPTISNSDFMCVGWSSTTCHDGIGRMTICIQGNNDNATATVYYNRRLTTTIKTWARNILRTQESECVCHNGICAVVMTDGSASSQAYTKVMYFHKGLVVKEEALKGSARHIEECSCYGHSQKVTCVCRDNWQGANRPIIEIDMNTLEHTSRYVCTGILTDTSRPGDKSSGDCSNPIAGSPGAPGVKGFGFLNGDNTWLGRTISPRSRSGFEMLKIPNAGTDPNSRIAGRQEIVDNNNWSGYSGSFIDYWNDNSECYNPCFYVELIRGRPEEAKYVWWTSNSLIALCGSPFPVGSGSFPDGAQIQYFS

SEQ ID NO: 23629 - protein, 471 aa, Artificial Sequence
  neuraminidase__InfluenzaA__AGQ81869
MNPNQKLFALSGVAIALSVLNLLIGISNVGLNVSLHLKEKGPKQEENSTCTTINQNNTTIVENTYVNNTTIISKETELKTPSYLLLNKSLCNVEGWVVIAKDNAVRFGESEQIIVTREPYVSCDPTGCKMYALHQGTTIRNKHSNGTIHDRTAFRGLISTPLGTPPTVSNSDFICVGWSSTTCHDGIGRMTICIQGNNDNATATVYYNRRLTTTIRTWARNILRTQESECVCHNGTCAVVMTDGSASSQAYTKVMYFHKGLVIKEEALKGSARHIEECSCYGHSQKATCVCRDNWQGANRPIIEIDMNTLEHTSRYVCTGILTDTSRPGDKSSGDCSNPITGSPGAPGVKGFGFLNGDNTWLGRTISPRSRSGFEMLKIPNAGTDPNSRIAERQEIVDNNNWSGYSGSFIDYWNNDSECYNPCFYVELIRGRPEEAKYVWWTSNSLIALCGSPFPVGSGSFPDGAQIQYFS

SEQ ID NO: 23630 - protein, 471 aa, Artificial Sequence
  neuraminidase__InfluenzaA__AGQ81870
MNPNQKLFALSGVAIALSVLNLLIGISNVGLNVSLHLKEKGPKQEENSTCTTINQNNTTIVENTYVNNTTIISKETELKPPSYLLLNKSLCNVEGWVVIAKDNAVRFGESEQIIVTREPYVSCDPTGCKMYALHQGTTIRNKHSNGTIHDRTAFRGLISTPLGTPPTVSNSDFICVGWSSTTCHDGIGRMTICIQGNNDNATATVYYNRRLTTTIRTWARNILRTQESECVCHNGTCAVVMTDGSASSQAYTKVMYFHKGLVIKEEALKGSARHIEECSCYGHSQKATCVCRDNWQGANRPIIEIDMNTLEHTSRYVCTGILTDTSRPGDKSSGDCSNPITGSPGAPGVKGFGFLNGDNTWLGRTISPRSRSGFEMLKIPNAGTDPNSRIAERQEIVDNNNWSGYSGSFIDYWNNDSECYNPCFYVELIRGRPEEAKYVWWTSNSLIALCGSPFPVGSGSFPDGAQIQYFS

SEQ ID NO: 23631 - protein, 471 aa, Artificial Sequence
  neuraminidase__InfluenzaA__AGQ81871
MNPNQKLFALSGVAIALSVLNLLIGISNVGLNVSLHLKEKGPKQEENSTCTTINQNNTTIVENTYVNNTTIISKETELKTPSYLLLNKSLCNVEGWVVIAKDNAVRFGESEQIIVTREPYVSCDPTGCKMYALHQGTTIRNKHSNGTIHDRTAFRGLISTPLGTPPTVSNSDFICIGWSSTTCHDGIGRMTICIQGNNDNATATVYYNRRLTTTIRTWARNILRTQESECVCHNGTCAVVMTDGSASSQAYTKVMYFHKGLVIKEEALKGSARHIEECSCYGHSQKATCVCRDNWQGANRPIIEIDMNTLEHTSRYVCTGILTDTSRPGDKSSGDCSNPITGSPGAPGVKGFGFLNGDNTWLGRTISPRSRSGFEMLKIPNAGTDPNSRIAERQEIVDNNNWSGYSGSFIDYWNNDSECYNPCFYVELIRGRPEEAKYVWWTSNSLIALCGSPFPVGSGSFPDGAQIQYFS

SEQ ID NO: 23632 - protein, 471 aa, Artificial Sequence
  neuraminidase__InfluenzaA__AGQ81872
MNPNQKLFALSGVAIALSVLNLLIGISNVGLNVSLHLKEKGPKQEENSTCTTINQNNTTIVENTYVNNTTIISKETELKTPSYLLLNKSLCNVEGWVVIAKDNAVRFGESEQIIVTREPYVSCDPTGCKMYALHQGTTIRNKHSNGTIHDRTAFRGLISTPLGTPPSVSNSDFICVGWSSTTCHDGIGRMTICIQGNNDNATATVYYNRRLTTTIRTWARNILRTQESECVCHNGTCAVVMTDGSASSQAYTKVMYFHKGLVIKEEALKGSARHIEECSCYGHSQKATCVCRDNWQGANRPIIEIDMNTLEHTSRYVCTGILTDTSRPGDKSSGDCSNPITGSPGAPGVKGFGFLNGDNTWLGRTISPRSRSGFEMLKIPNAGTDPNSRIAERQEIVDNNNWSGYSGSFIDYWNNDSECYNPCFYVELIRGRPEEAKYVWWTSNSLIALCGSPFPVGSGSFPDGAQIQYFS

SEQ ID NO: 23633 - protein, 471 aa, Artificial Sequence
  neuraminidase__InfluenzaA__AGQ81875
MNPNQKLFALSGVAIALSVLNLLIGISNVGLNVSLHLKEKGPKQEENSTCMTINQNNTTVVENTYVNNTTIITKETELETPSYLLLNKGLCNVEGWVVIAKDNAVRFGETEQIIVTREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASSQAHTKVIYFHKGLIVKEEALKGSARHIEECSCYGHSQKVTCVCRDNWQGANRPIIEIDMNTLEHTSRYVCTGILTDTSRPGDKSTGDCSNPITGSPGAPGVKGFGYLNGDNTWLGRTISPRSRSGFEMLKIPNAGTDPNSRITERQEIVDNNNWSGYSGSFVDYWNDNSECYNPCFYVELIRGRPEEAKYVWWTSNSIIALCGSPFPVGSGSFPDGAQIQYFS

SEQ ID NO: 23634 - protein, 471 aa, Artificial Sequence
  neuraminidase__InfluenzaA__AGQ81876
MNPNQKLFALSGVAIALSVLNLLIGISNVGLNVSLHLKEKGPKQEENSTCMTINQNNTTVVENTYVNNTTIITKETELETPSYLLLNKGLCNVEGWVVIAKDNAVRFGETEQIIVTREPYVSCDPNGCKMYALHQGTTIRNKHSNGTIHDRTAFRGLISTPLGTPPTVSNSDFICVGWSSTTCHDGIGRMTICIQGDNDNATATVYYNRRLTTTIKTWARNILRTQESECVCHNGTCAVVMTDGSASSQAHTKVIYFHKGLIVKEEALKGSARHIEECSCYGHSQKVTCVCRDNWQGANRPIIEIDMNTLEHTSRYVCTGILTDTSRPGDKSTGDCSNPITGSPGAPGVKGFGYLNGDNTWLGRTISPRSRSGFEMLKIPNAGTDPNSRITERQEIVDNNNWSGYSGSFVDYWNDNSECYNPCFYVELIRGRPEEAKYVWWTSNSIIALCGSPFPVGSGSFPDGAQIQYFS

SEQ ID NO: 23635 - protein, 471 aa, Artificial Sequence
  neuraminidase__InfluenzaA__AGQ81877
MNPNQKLFALSGVAIALSVLNLLIGISNVGLNVSLHLKEKGPKQEENSTCTTINQNNTTVVENTYVNNTTIITKETELKTPSYLLLNKSLCNVEGWVVIAKDNAVRFGESEQIIVTREPYVSCDPTGCKMYALHQGTTIRNKHSNGTIHDRTAFRGLISTSLGTPPTISNSDFMCVGWSSTTCHDGIGRMTICIQGNNDNATATVYYNRRLTTTIKTWARNILRTQESECVCHNGICAVVMTDGSASSQAYTKVMYFHKGLVVKEEALKGSARHIEECSCYGHSQKVTCVCRDNWQGANRPIIEIDMNTLEHTSRYVCTGILTDTSRPGDKSSGDCSNPITGSPGAPGVKGFGFLNGDNTWLGRTISPRSRSGFEMLKIPNAGTDPNSRIAGRQEIVDNNNWSGYSGSFIDYWNDNSECYNPCFYVELIRGRPEEAKYVWWTSNSLIALCGSPFPVGSGSFPDGAQIQYFS

SEQ ID NO: 23636 - protein, 471 aa, Artificial Sequence
  neuraminidase__InfluenzaA__AGQ81878
MNPNQKLFALSGVAIALSVLNLLIGISNVGLNVSLHLKEKGPKQEENLTCTTINQNNTTVVENTYVNNTTIITKETDLKAPSYLLLNKSLCNVEGWVVIAKDNAVRFGESEQIIVTREPYVSCDPTGCKMYALHQGTTIRNKHSNGTIHDRTAFRGLISTPLGTPPTVSNSDFMCVGWSSTTCHDGIGRMTICIQGNNDNATATVYYNRRLTTTIKTWARNILRTQESECVCHNGTCAVVMTDGSASSQAYTKVMYFHKGLVVKEEALKGSARHIEECSCYGHSQKVTCVCRDNWQGANRPIIEIDMNTLEHTSRYVCTGILTDTSRPGDKSSGDCSNPITGSPGAPGVKGFGFLNGDNTWLGRTISPRSRSGFEMLKIPNAGTDPNSRIAERQEIVDNNNWSGYSGSFIDYWNDNSECYNPCFYVELIRGRPEEAKYVWWTSNSLIALCGSPFPIGSGSFPDGAQIQYFS

SEQ ID NO: 23637 - protein, 471 aa, Artificial Sequence
  neuraminidase__InfluenzaA__AGQ81882
MNPNQKLFALSGVAIALSVLNLLIGISNVGLNVSLHLKEKGAKQEENLTCTTINQNNTTVVENTYVNNTTVITKEADWKTPSYLLLNKSLCNVEGWVVIAKDNAIRFGESEQIIVTREPYVSCDPTGCKMYALHQGTTIRNKHSNGTIHDRTAFRGLISTPLGTPPTVSNSDFMCVGWSSTTCHDGIGRMTICIQGNNDNATATVYYNGRLTTTIKTWARNILRTQESECVCHNGTCAVVMTDGSASSQAYTKVMYFHKGLVIKEEALKGSARHIEECSCYGHSQKVTCVCRDNWQGANRPIIEIDMNTLEHTSRYVCTGILTDTSRPGDKSSGDCSNPITGSPGAPGVKGFGFLNGDNTWLGRTISPRSRSGFEMLKIPNAGIDPNSRIAERQEIVDNNNWSGYSGSFIDYWNDNSECYNPCFYVELIRGRPEEAKYVWWTSNSLIALCGSPFPVGSGSFPDGAQIQYFS

SEQ ID NO: 23638 - protein, 471 aa, Artificial Sequence
  neuraminidase__InfluenzaA__AGQ81883
MNPNQKLFALSGVAIALSVLNLLIGISNVGLNVSLHLKEKGPKQEENLTCTTINQNNTTVVENTYVNNTTVITKEADWKTPSYLLLNKSLCNVEGWVVIAKDNAIRFGESEQIIVTREPYVSCDPTGCKMYALHQGTTIRNKHSNGTIHDRTAFRGLISTPLGTPPTVSNSDFMCVGWSSTTCHDGIGRMTICIQGNNDNATATVYYNGRLTTTIKTWARNILRTQESECVCHNGTCAVVMTDGSASSQAYTKVMYFHKGLVIKEEALKGSARHIEECSCYGHSQKVTCVCRDNWQGANRPIIEIDMNTLEHTSRYVCTGILTDTSRPGDKSSGDCSNPITGSPGAPGVKGFGFLNGDNTWLGRTISPRSRSGFEMLKIPNAGIDPNSRIAERQEIVDNNNWSGYSGSFIDYWNDNSECYNPCFYVELIRGRPEEAKYVWWTSNSLIALCGSPFPVGSGSFPDGAQIQYFS

SEQ ID NO: 23639 - protein, 471 aa, Artificial Sequence; identical to SEQ ID NO: 23638
  neuraminidase__InfluenzaA__AGQ81884

SEQ ID NO: 23640 - protein, 471 aa, Artificial Sequence; identical to SEQ ID NO: 23638
  neuraminidase__InfluenzaA__AGQ81885

SEQ ID NO: 23641 - protein, 471 aa, Artificial Sequence; identical to SEQ ID NO: 23638
  neuraminidase__InfluenzaA__AGQ81886

SEQ ID NO: 23642 - protein, 451 aa, Artificial Sequence
  neuraminidase__InfluenzaA__AGQ81888
MNPNQKLFALSGVAIALSVLNLLIGLSNVGLNVSLHLKEAGPKQEENLTCMTTKETELGTPSYLLLNKSLCNVEGWVVIAKDNAVRFGESEQIIITREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASSQAHTKVMYFHKGLVVKEEALKGSAKHIEECSCYGHNQKVTCVCRDNWQGANRPIIEIDMNTLEHTSRYVCTGILTDTSRPGDKPTGDCSNPITGSPGAPGVKGFGFLNGDNTWLGRTISPRSRSGFEMLKIPNAGIDPNSRIAERQEIVDNSNWSGYSGSFIDYWNDNSECYNPCFYVELIRGRPEEAKYVWWTSNSLIALCGSPFPVGSGSFPDGAQIQYFS

SEQ ID NO: 23643 - protein, 451 aa, Artificial Sequence
  neuraminidase__InfluenzaA__AGQ81889
MNPNQKLFALSGVAIALSVLNLLIGLSNVGLNVSLHLKETGPKQEENLTCMTTKETELGTPSYLLLNKSLCNVEGWVVIAKDNAVRFGESEQIIITREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASSQAHTKVMYFHKGLVVKEEALKGSAKHIEECSCYGHNQKVTCVCRDNWQGANRPIIEIDMNTLEHTSRYVCTGILTDTSRPGDKPTGDCSNPITGSPGAPGVKGFGFLNGDNTWLGRTISPRSRSGFEMLKIPNAGIDPNSRIAERQEIVDNSNWSGYSGSFIDYWNDNSECYNPCFYVELIRGRPEEAKYVWWTSNSLIALCGSPFPVGSGSFPDGAQIQYFS

SEQ ID NO: 23644 - protein, 451 aa, Artificial Sequence; identical to SEQ ID NO: 23643
  neuraminidase__InfluenzaA__AGQ81890

SEQ ID NO: 23645 - protein, 451 aa, Artificial Sequence; identical to SEQ ID NO: 23643
  neuraminidase__InfluenzaA__AGQ81891

SEQ ID NO: 23646 - protein, 451 aa, Artificial Sequence
  neuraminidase__InfluenzaA__AGQ81893
MNPNQKLFALSGVAIALSVLNLLIGLSNVGLNVSLHLKETGPKQEENLTCMTTKETELGTPSYLLLNKSLCNVEGWVVIAKDNAVRFGESEQIIITREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASSQAHTKVMYFHKGLVVKEEALKGSAKHIEECSCYGHNQKVTCVCRDNWQGANRPIIEIDMNTLEHTSRYVCTGILTDTSRPGDKPTGDCSNPITGSPGAPGVKGFGFLNGDNTWLGRTISPRSRSGFEMLKIPNAGIDPNSRIAERQEIVDNSNWSGYSGSFIDYWNDNSECYNPCFYVELIRGRPEEAEYVWWTSNSLIALCGSPFPVGSGSFPDGAQIQYFS

SEQ ID NO: 23647 - protein, 451 aa, Artificial Sequence; identical to SEQ ID NO: 23643
  neuraminidase__InfluenzaA__AGQ81894

SEQ ID NO: 23648 - protein, 451 aa, Artificial Sequence; identical to SEQ ID NO: 23643
  neuraminidase__InfluenzaA__AGQ81895

SEQ ID NO: 23649 - protein, 451 aa, Artificial Sequence; identical to SEQ ID NO: 23643
  neuraminidase__InfluenzaA__AGQ81896

SEQ ID NO: 23650 - protein, 451 aa, Artificial Sequence; identical to SEQ ID NO: 23643
  neuraminidase__InfluenzaA__AGQ81897

SEQ ID NO: 23651 - protein, 451 aa, Artificial Sequence; identical to SEQ ID NO: 23643
  neuraminidase__InfluenzaA__AGQ81898

SEQ ID NO: 23652 - protein, 451 aa, Artificial Sequence; identical to SEQ ID NO: 23643
  neuraminidase__InfluenzaA__AGQ81899

SEQ ID NO: 23653 - protein, 451 aa, Artificial Sequence; identical to SEQ ID NO: 23643
  neuraminidase__InfluenzaA__AGQ81900

SEQ ID NO: 23654 - protein, 451 aa, Artificial Sequence; identical to SEQ ID NO: 23643
  neuraminidase__InfluenzaA__AGQ81901

SEQ ID NO: 23655 - protein, 451 aa, Artificial Sequence; identical to SEQ ID NO: 23643
  neuraminidase__InfluenzaA__AGQ81902

SEQ ID NO: 23656 - protein, 451 aa, Artificial Sequence; identical to SEQ ID NO: 23643
  neuraminidase__InfluenzaA__AGQ81903

SEQ ID NO: 23657 - protein, 451 aa, Artificial Sequence
  neuraminidase__InfluenzaA__AGQ81904
MNPNQKLFALSGVAIALSVLNLLIGLSNVGLNVSLHLKETGPKQEENLTCMTTKETELGTPSYLLLNKSLCNVEGWVVIAKDNAVRFGESEQIIITREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASSQAHTKVMYFHKGLVVKEEALKGSAKHIEECSCYGHNQKVTCVCRDNWQGANRPIIEIDMNTLEHTSRYVCTGILTDTSRPGDKPTGDCSNPITGSPGAPGVKGFGFLNGDNTWLGRTISPRSRSGFEMLKIPNAGIDPNSRITERQEIVDNSNWSGYSGSFIDYWNDNSECYNPCFYVELIRGRPEEAKYVWWTSNSLIALCGSPFPVGSGSFPDGAQIQYFS

SEQ ID NO: 23658 - protein, 451 aa, Artificial Sequence; identical to SEQ ID NO: 23643
  neuraminidase__InfluenzaA__AGQ81905

SEQ ID NO: 23659 - protein, 451 aa, Artificial Sequence
  neuraminidase__InfluenzaA__AGQ81906
MNPNQKLFALSGVAIALSVLNLLIGLSNVGLNVSLHLKETGPKQEENLTCMTTKETELGTPSYLLLNKSLCNVEGWVVIAKDNAVRFGESEQIIITREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASSQAHTKVMYFHKGLVVKEEALKGSARHIEECSCYGHNQKVTCVCRDNWQGANRPIIEIDMNTLEHTSRYVCTGILTDTSRPGDKPTGDCSNPITGSPGAPGVKGFGFLNGDNTWLGRTISPRSRSGFEMLKIPNAGIDPNSRIAERQEIVDNSNWSGYSGSFIDYWNDNSECYNPCFYVELIRGRPEEAKYVWWTSNSLIALCGSPFPVGSGSFPDGAQIQYFS

SEQ ID NO: 23660 - protein, 451 aa, Artificial Sequence; identical to SEQ ID NO: 23643
  neuraminidase__InfluenzaA__AGQ81907

SEQ ID NO: 23661 - protein, 451 aa, Artificial Sequence
  neuraminidase__InfluenzaA__AGQ81908
MNPNQKLFALSGVAIALSVLNLLIGLSNVGLNVSLHLKETGPKQEENLTCMTTKETELGTPSYLLLNKSLCNVEGWVVIAKDNAVRFGESEQIIITREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASNQAHTKVMYFHKGLVVKEEALKGSAKHIEECSCYGHNQKVTCVCRDNWQGANRPIIEIDMNTLEHTSRYVCTGILTDTSRPGDKPTGDCSNPITGSPGAPGVKGFGFLNGDNTWLGRTISPRSRSGFEMLKIPNAGIDPNSRITERQEIVDNSNWSGYSGSFIDYWNDNSECYNPCFYVELIRGRPEEAKYVWWTSNSLIALCGSPFPVGSGSFPDGAQIQYFS

SEQ ID NO: 23662 - protein, 451 aa, Artificial Sequence; identical to SEQ ID NO: 23643
  neuraminidase__InfluenzaA__AGQ81909

SEQ ID NO: 23663 - protein, 451 aa, Artificial Sequence
  neuraminidase__InfluenzaA__AGQ81910
MNPNQKLFALSGVAIALSVLNLLIGLSNVGLNVSLHLKETGPKQEENLTCMTTKETELGTPSYLLLNKSLCNVEGWVVIAKDNAVRFGESEQIIITREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASGQAHTKVMYFHKGLVVKEEALKGSAKHIEECSCYGHNQKVTCVCRDNWQGANRPIIEIDMNTLEHTSSYVCTGILTDTSRPGDKPTGDCSNPITGSPGAPGVKGFGFLNGDNTWLGRTISPRSRSGFEMLKIPNAGIDPNSRIAERQEIVDNSNWSGYSGSFIDYWNDNSECYNPCFYVELIRGRPEEAKYVWWTSNSLIALCGSPFPVGSGSFPDGAQIQYFS

SEQ ID NO: 23664 - protein, 451 aa, Artificial Sequence
  neuraminidase__InfluenzaA__AGQ81911
MNPNQKLFALSGVAIALSVLNLLIGLSNVGLNVSLHLKETGPKQEENLTCMTTKETELGTPSYLLLNKSLCNVEGWVVIAKDNAVRFGESEQIIITREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASGQAHTKVMYFHKGLVVKEEALKGSAKHIEECSCYGHNQNVTCVCRDNWQGANRPIIEIDMNTLEHTSRYVCTGILTDTSRPGDKPTGDCSNPITGSPGAPGVKGFGFLNGDNTWLGRTISPRSRSGFEMLKIPNAGIDPNSRIAERQEIVDNSNWSGYSGSFIDYWNDNSECYNPCFYVELIRGRPEEAKYVWWTSNSLIALCGSPFPVGSGSFPDGAQIQYFS

SEQ ID NO: 23665 - protein, 451 aa, Artificial Sequence; identical to SEQ ID NO: 23643
  neuraminidase__InfluenzaA__AGQ81912

SEQ ID NO: 23666 - protein, 451 aa, Artificial Sequence
  neuraminidase__InfluenzaA__AGQ81913
MNPNQKLFALSGVAITLSVLNLLIGLSNVGLNVSLHLKETGPKQEENLTCMTTKETELGTPSYLLLNKSLCNVEGWVVIAKDNAVRFGESEQIIITREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASGQAHTKVMYFHKGLVVKEEALKGSAKHIEECSCYGHNQKVTCVCRDNWQGANRPIIEIDMNTLEHTSRYVCTGILTDTSRPGDKPTGDCSNPITGSPGAPGVKGFGFLNGDNTWLGRTISPRSRSGFEMLKIPNAGIDPNSRIAERQEIVDNSNWSGYSGSFIDYWNDNSECYNPCFYVELIRGRPEEAKYVWWTSNSLIALCGSPFPVGSGSFPDGAQIQYFS

SEQ ID NO: 23667 - protein, 451 aa, Artificial Sequence; identical to SEQ ID NO: 23643
  neuraminidase__InfluenzaA__AGQ81914

SEQ ID NO: 23668 - protein, 451 aa, Artificial Sequence; identical to SEQ ID NO: 23643
  neuraminidase__InfluenzaA__AGQ81915

SEQ ID NO: 23669 - protein, 471 aa, Artificial Sequence
  neuraminidase__InfluenzaA__AGQ81917
MNPNQKLFALSGVAIALSVLNLLIGLSNVGLNVSLHLKETGPKQEENLTCMTINQNNTTVVENTYVNNTTIITKETELETPNYLLLNKSLCNVEGWVVVAKDNAVRFGESEQIIVTREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASSQAHTKVMYFHKGLVIKEEALKGSAKHIEECSCYGHNQKVTCVCRDNWQGANRPIIEIDMNTLEHTSRYVCTGILTDTSRPGDKPTGDCSNPITGSPGAPGVKGFGFLNGDNTWLGRTISPRSRSGFEMLKIPNAGIDPNSRIAERQEIVDNSNWSGYSGSFIDYWNDNSECYNPCFYVELIRGRPEEAKYVWWTSNSLIALCGSPFPVGSGSFPDGAQIQYFS

SEQ ID NO: 23670 - protein, 451 aa, Artificial Sequence
  neuraminidase__InfluenzaA__AGQ81918
MNPNQKLFALSGVAIALSVLNLLIGLSNVGLNVSLHLKETGPKQEENLTCMTTKETELGTPSYLLLNKGLCNVEGWVVIAKDNAVRFGESEQIIITREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASSQAHTKVMYFHKGLVVKEEALKGSAKHIEECSCYGHNQKVTCVCRDNWQGANRPIIEIDMNTLEHTSRYVCTGILTDTSRPGDKPTGDCSNPITGSPGAPGVKGFGFLNGDNTWLGRTISPRSRSGFEMLKIPNAGIDPNSRIAERQEIVDNSNWSGYSGSFIDYWNDNSECYNPCFYVELIRGRPEEAKYVWWTSNSLIALCGSPFPVGSGSFPDGAQIQYFS

SEQ ID NO: 23671 - protein, 451 aa, Artificial Sequence; identical to SEQ ID NO: 23643
  neuraminidase__InfluenzaA__AGQ81919

SEQ ID NO: 23672 - protein, 451 aa, Artificial Sequence; identical to SEQ ID NO: 23643
  neuraminidase__InfluenzaA__AGQ81920

SEQ ID NO: 23673 - protein, 451 aa, Artificial Sequence
  neuraminidase__InfluenzaA__AGQ81921
MNPNQKLFALSGVAIALSVLNLLIGLSNVGLNVSLHLKETGPKQEENLTCMTTKETELGTPSYLLLNKSLCNVEGWVVIAKDNAVRFGESEQIIITREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASGQAHTKVMYFHKGLVVKEEALKGSAKHIEECSCYGHNQKVTCVCRDNWQGANRPIIEIDMNTLEHTSRYVCTGILTDTSRPGDKPTGDCSNPITGSPGAPGVKGFGFLNGDNTWLGRTISPRSRSGFEMLKIPNAGIDPNSRIAERQEIVDNSNWSGYSGSFIDYWNDNSECYNPCFYVELIRGRPEEAKYVWWTSNSLIALCGSPFPVGSGSFPDGAQIQYFS

SEQ ID NO: 23674 - protein, 451 aa, Artificial Sequence; identical to SEQ ID NO: 23643
  neuraminidase__InfluenzaA__AGQ81922

SEQ ID NO: 23675 - protein, 451 aa, Artificial Sequence; identical to SEQ ID NO: 23673
  neuraminidase__InfluenzaA__AGQ81923

SEQ ID NO: 23676 - protein, 451 aa, Artificial Sequence
  neuraminidase__InfluenzaA__AGQ81924
MNPNQKLFALSGVAIALSVLNLLIGLSNVGLNVSLHLKETGPKQEENLTCMTTKETELGTPSYLLLNKSLCNVEGWVVIAKDNAVRFGESEQIIITREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSANSQAHTKVMYFHKGLVVKEEALKGSAKHIEECSCYGHNQKVTCVCRDNWQGANRPIIEIDMNTLEHTSRYVCTGILTDTSRPGDKPTGDCSNPITGSPGAPGVKGFGFLNGDNTWLGRTISPRSRSGFEMLKIPNAGIDPNSRIAERQEIVDNSNWSGYSGSFIDYWNDNSECYNPCFYVELIRGRPEEAKYVWWTSNSLIALCGSPFPVGSGSFPDGAQIQYFS

SEQ ID NO: 23677 - protein, 451 aa, Artificial Sequence; identical to SEQ ID NO: 23643
  neuraminidase__InfluenzaA__AGQ81925

SEQ ID NO: 23678 - protein, 451 aa, Artificial Sequence; identical to SEQ ID NO: 23643
  neuraminidase__InfluenzaA__AGQ81926

SEQ ID NO: 23679 - protein, 451 aa, Artificial Sequence; identical to SEQ ID NO: 23643
  neuraminidase__InfluenzaA__AGQ81927

SEQ ID NO: 23680 - protein, 451 aa, Artificial Sequence; identical to SEQ ID NO: 23643
  neuraminidase__InfluenzaA__AGQ81928

SEQ ID NO: 23681 - protein, 451 aa, Artificial Sequence; identical to SEQ ID NO: 23643
  neuraminidase__InfluenzaA__AGQ81929

SEQ ID NO: 23682 - protein, 470 aa, Artificial Sequence
  neuraminidase__InfluenzaA__AGQ81930
MNPNQKIITIGSISLGLVVFNVLLHVVSIIVTVLVLGRGGNSGICNETVVREYNETVRIEKITQWHNTSVVEYVPYWSEGNYMNNTEAICDVKGFAPFSKDNGIRIGSRGHVFVIREPFVSCSPTECRTFFLTQGSLLNDKHSNGTVKDRSPFRTLMSVEVGQSPNVYQARFEAVAWSATACHDGKKWMTIGVTGPDSKAVAVVHYGGVPTDVVNSWAGDILRTQESSCTCIQGNCYWVMTDGPANRQAQYRIYKANQGKIVGQTDISFNGGHIEECSCYPNDGKVECVCRDNWTGTNRPVLVISPDLSYRVGYLCAGLPSDTPRGEDAQFTGSCTSPMGNQGYGVKGFGFRQGTDVWMGRTISRTSRSGFEILRIKNGWTQTSKEQVRKQVVVDNLNWSGYSGSFTLPVELSGKDCLVPCFWVEMIRGKPEEKTIWTSSSSIVMCGVDYEVADWSWHDGAILPFDIDKM

SEQ ID NO: 23683 - protein, 470 aa, Artificial Sequence
  neuraminidase__InfluenzaA__AGQ81931
MNPNQKIITIGSLSLGLVVLNILLHIISITITVLVIPRNGNTGSCNETVIREYNETVRIEKITQWHNTNIIEYIEKPENDLFMNNTGPLCDAKGFAPFSKDNGIRIGSKGHVFVIREPFVSCSPTECRTFFLTQGSLLNDKHSNGTVKDRSPYRTLMSVEIGQSPNVYQARFEAVAWSATACHDGKKWMTIGVTGPDAKAVAVVHYGGIPTDVINSWAGDILRTQESSCTCIQGECYWVMTDGPANRQAQYRAFKAKQGKIIGQTEISFNGGHIEECSCYPNEGKVECVCRDNWTGTNRPVLVISSDLSYRVGYLCAGLPSDTPRGEDSQFTGSCTSPMGNQGYGVKGFGFRQGNDVWMGRTISRTSRSGFEILKIRNGWIQNSKEQIKRQVVVDNSNWSGYSGSFTLPVELTRRNCLVPCFWVEMIRGKPEEKTIWTSSSSIVMCGVDHEIANWSWHDGAILPFDIDKM

SEQ ID NO: 23684 - protein, 470 aa, Artificial Sequence
  neuraminidase__InfluenzaA__AGQ81932
MNPNQKIITIGSISLGLVVFNVLLHVVSIIVTVLILGRGGNNGICNETVVREYNETVRIEKITQWHNTSVVEYVPYWNEGTYMNNTEAICDVKGFAPFSKDNGIRIGSRGHVFVIREPFVSCSPTECRTFFLTQGSLLNDKHSNGTVKDRSPFRTLMSVEVGQSPNVYQARFEAVAWSATACHDGKKWMTIGVTGSDSKAVAVVHYGGVPTDVVNSWAGDILRTQESSCTCIQGNCYWVMTDGPANRQAQYRIYKANQGKVIGQTDISFNGGHIEECSCYPNDGKVECVCRDNWTGTNRPVLVISPDLSYRVGYLCAGLPSDTPRGEDAQFTGSCTSPMGNQGYGVKGFGFRQGTDVWMGRTISQTSRSGFEILRVKNGWTQTSKEQVRKQVVVDNLNWSGYSGSFTLPIELSGKDCLVPCFWVEMIRGKPEEKSIWTSSSSIVMCGVDYEVADWSWHDGAILPFDIDKM

SEQ ID NO: 23685 - protein, 470 aa, Artificial Sequence
  neuraminidase__InfluenzaA__AGQ81934
MNPNQKILCTSATAIVIGTIAVLIGIANLGLNIGLHLKPSCNCSHSQPETTNTSQTIINNYYNETNITQISNTNIQMEERASRDFNNLTKGLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGRILKWESLTGTAKHIEECSCYGERTGITCTCRDNWQGSNRPVIRIDPVAMTHTSQYICSPVLTDNPRPNDPNVGKCNDPYPGNNNNGVKGFSYLDGVNTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWDWPDGAKIEYFL

SEQ ID NO: 23686 - protein, 470 aa, Artificial Sequence; identical to SEQ ID NO: 23685
  neuraminidase__InfluenzaA__AGQ81935

SEQ ID NO: 23687 - protein, 470 aa, Artificial Sequence; identical to SEQ ID NO: 23685
  neuraminidase__InfluenzaA__AGQ81936

SEQ ID NO: 23688 - protein, 470 aa, Artificial Sequence; identical to SEQ ID NO: 23685
  neuraminidase__InfluenzaA__AGQ81937

SEQ ID NO: 23689 - protein, 470 aa, Artificial Sequence; identical to SEQ ID NO: 23685
  neuraminidase__InfluenzaA__AGQ81938

SEQ ID NO: 23690 - protein, 470 aa, Artificial Sequence; identical to SEQ ID NO: 23685
  neuraminidase__InfluenzaA__AGQ81939

SEQ ID NO: 23691 - protein, 470 aa, Artificial Sequence
  neuraminidase__InfluenzaA__AGQ81940
MNPNQKILCTSATAIIIGAIAVLIGIANLGLNIGLHLKPSCNCSHSQPETTNTSQTIINNYYNETNITQISNTNIQMEERASKGFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLAGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWNWPDGAKIEYFL

SEQ ID NO: 23692 - protein, 470 aa, Artificial Sequence
  neuraminidase__InfluenzaA__AGQ81941
MNPNQKILCTSATAIIIGTIAVLIGVANLGLNIGLHLKPGCNCSHSQPEATNTSQTIINNYYNETNITQISNTNIQMEERPNRGFNNLTKGLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRVYYFREGKILKWESLTGTARHIEECSCYGERTGITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWDWPDGAKIEYFL

SEQ ID NO: 23693 - protein, 470 aa, Artificial Sequence
  neuraminidase__InfluenzaA__AGQ81942
MNPNQKILCTSATAIIIGTIAVLIGVANLGLNIGLHLKPGCNCSHSQPEATNTSQTIINNYYNETNITQISNTNIQMEERPSRGFNNLTKGLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAIVWYNRRPVAEINTWARNILRTQESECVCHNGVCPVVFTDGSATGPADTRVYYFREGKILKWESLTGTARHIEECSCYGERTGITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPIQGQTIILNTDWSGYSGSFMDYWAEGDCYRACFYVELIRGRPKEDKVWWTSNSIVSMCSSTEFLGQWDWPDGAKIEYFL

SEQ ID NO: 23694 - protein, 470 aa, Artificial Sequence
  neuraminidase__InfluenzaA__AGQ81943
MNPNQKILCTSATAIIIGAIAVLIGIANLGLNIGLHLKPSCNCSHSQPETTNTSQTIINNYYNETNITQISNTNIQMEERTSRGFNNLTKGLCTINSWHIYGKDNAIRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGRILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWNWPDGAKIEYFL

SEQ ID NO: 23695 - protein, 470 aa, Artificial Sequence; identical to SEQ ID NO: 23685
  neuraminidase__InfluenzaA__AGQ81944

SEQ ID NO: 23696 - protein, 470 aa, Artificial Sequence
  neuraminidase__InfluenzaA__AGQ81947
MNPNQKILCTSATALVIGTIAVLIGIANLGLNIGLHLKPSCNCSHSQPEATNTSQTIINNYYNETNITQISNTNIQMEERASRSFNNLTKGLCTINSWHIYGKDNAIRIGENSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWNWPDGAKIEYFL

SEQ ID NO: 23697 - protein, 470 aa, Artificial Sequence
  neuraminidase__InfluenzaA__AGQ81948
MNPNQKILCTSATAIIIGAIAVLIGIANLGLNIGLHLKPSCNCSHSQPETTNTSQTIINNYYNETNITQISNTNIQMEERTSRGFNNLTKGLCTINSWHIYGKDNAIRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGRILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNTDWSGYSGSFMDYWAEGECYRACFYVELIRGRPKEDKVWWTSNSIVSMCSSTEFLGQWNWPDGAKIEYFL

SEQ ID NO: 23698 - protein, 470 aa, Artificial Sequence
  neuraminidase__InfluenzaA__AGQ81951
MNPNQKILCTSATAIVIGTIAVLIGVANLGLNIGLHLKPGCNCSQSQPEATNTSQTIINNYYNETNITQISNTNIQMEERANRGFNNLTKGLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRVYYFREGKILKWESLTGTAKHIEECSCYGERTGITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWNWPDGAKIEYFL

SEQ ID NO: 23699 - protein, 470 aa, Artificial Sequence
  neuraminidase__InfluenzaA__AGQ81952
MNPNQKILCTSATAIVIGTIAVLIGVANLGLNIGLHLKPGCNCSHSQPEATNTSQTIINNYYNETNITQISNTNIQMEERANRGFNNLTKGLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRVYYFREGKILKWESLTGTAKHIEECSCYGERTGITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWNWPDGAKIEYFL

SEQ ID NO: 23700 - protein, 470 aa, Artificial Sequence
  neuraminidase__InfluenzaA__AGQ81954
MNPNQKILCTSATAIVIGTIAVLIGVANLGLNIGLHLKPSCNCSHSQPEATNTSQTIINNYYNETNITQISNTNIQMEERASRGFNNLTKGLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRVYYFKEGKILKWESLTGTAKHIEECSCYGERTGITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWNWPDGAKIEYFL

SEQ ID NO: 23701 - protein, 470 aa, Artificial Sequence
  neuraminidase__InfluenzaA__AGQ81956
MNPNQKILCTSATAIVIGTIAVLIGVANLGLNIGLHLKPSCNCSHSQPEATNTSQTIINNYYNETNITQISNTNIQMEERASRGFNNLTKGLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAIVWYNRRPVAEINTWARNILRTQESECVCHNGVCPVVFTDGSATGPADTRVYYFKEGKILKWESLTGTAKHIEECSCYGERTGITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWNWPDGAKIEYFL

SEQ ID NO: 23702 - protein, 470 aa, Artificial Sequence
  neuraminidase__InfluenzaA__AGQ81957
MNPNQKILCTSATAIVIGTIAVLIGIANLGLNIGLHLKPSCNCSHSQPEATNTSQIIINNYYNETNITQVSNTNIQMEERASRGFNNLTKGLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPVQGQTIVLNTDWSGYSGSFMDYWAEGDCYRACFYVELIRGRPKEDKVWWTSNSIVSMCSSTEFLGQWNWPDGAKIEYFL

SEQ ID NO: 23703 - protein, 470 aa, Artificial Sequence; identical to SEQ ID NO: 23685
  neuraminidase__InfluenzaA__AGQ81958

SEQ ID NO: 23704 - protein, 470 aa, Artificial Sequence; identical to SEQ ID NO: 23685
  neuraminidase__InfluenzaA__AGQ81959

SEQ ID NO: 23705 - protein, 470 aa, Artificial Sequence
  neuraminidase__InfluenzaA__AGQ81960
MNPNQKILCTSATAIVIGTIAVLIGIANLGLNIGLHLKPNCNCSRSQPETTNTSQTIINNYYNETNITQISNTNIQMEERASRDFNNLTKGLCTINSWHIYGKDNAVRIGENSDVLVTREPYVSCDPNECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTEITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWDWPDGAKIEYFL

SEQ ID NO: 23706 - protein, 470 aa, Artificial Sequence; identical to SEQ ID NO: 23698
  neuraminidase__InfluenzaA__AGQ81961

SEQ ID NO: 23707 - protein, 470 aa, Artificial Sequence; identical to SEQ ID NO: 23698
  neuraminidase__InfluenzaA__AGQ81962

SEQ ID NO: 23708 - protein, 470 aa, Artificial Sequence
  neuraminidase__InfluenzaA__AGQ81963
MNPNQKILCTSATAIVIGTIAVLIGIANLGLNIGLHLKPSCNCSHSQPEETNTSQTIINNYYNETNITQISNTNIQMEERASRGFNNLTKGLCTINSWHIYGKDNAVRIGENSDVLVTREPYVSCDPNECRFYALSQGTTIRGKHSNGTIHDRSQYRALISWPLSSPPTVYNSRVECIGWSSTSCHDGKSRMSVCISGPNDNASAVVWYNRRPVAEINTWARNILRTQESECVCHNGVCPVVFTDGSATGPAHTRIYYFKEGKILKWESLTGTAKHIEECSCYGERTGITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPIQGQTIVLNTDWSGYSGSFMDYWTEGDCYRACFYVELIRGRPKEDKVWWTSNSIVSMCSSTEFLGQWDWPDGAKIEYFL

SEQ ID NO: 23709 - protein, 470 aa, Artificial Sequence
  neuraminidase__InfluenzaA__AGQ81964
MNPNQKILCTSATAIVIGTIAVLIGIANLGLNIGLHLKPSCNCSHSKPEETNASQTIINNYYNETNITQISNTNIQMEERASRGFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNVGKCNDPYPGNNNNGVKGFSYLDGVNTWLGRTTSTTSRSGYEMLKVPNALTDDRSKPIQGQTIVLNTDWSGYSGSFMDYWAEGDCYRACFYVELIRGRPKEDKVWWTSNSIVSMCSSTEFLGQWNWPDGAKIEYFL

SEQ ID NO: 23710 - protein, 470 aa, Artificial Sequence
  neuraminidase__InfluenzaA__AGQ81966
MNPNQRILCTSATAIVIGTIAVLIGVANLGLNIGLHLKPGCNCSHSQPEATNTSQTIINNYYNETNITQISNTNIQMEERANRGFNNLTKGLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRVYYFREGKILKWESLTGTAKHIEECSCYGERTGITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWNWPDGAKIEYFL

SEQ ID NO: 23711 - protein, 470 aa, Artificial Sequence
  neuraminidase__InfluenzaA__AGQ81967
MNPNQKILCTSATAIVIGIIAVLIGIANLGLNIGLHLKPSCNCSHSQPEATNASQTIINNYYNETNITQISNTNIQMEERASRGFNNLTKGLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPAETRIYYFKEGKILKWESLTGTAKHIEECSCYGERTGITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPIQGQIIVLNTDWSGYSGSFMDYWAEGDCYRACFYVELIRGRPKEDKVWWTSNSIVSMCSSTEFLGQWNWPDGAKIEYFL

SEQ ID NO: 23712 - protein, 470 aa, Artificial Sequence
  neuraminidase__InfluenzaA__AGQ81968
MNPNQKILCTSATAIVIGIIAVLIGIANLGLNIGLHLKPSCNCSHSQPEATNASQTIINNYYNETNITQISNTNIQMEERASRGFNNLTKGLCTINSWHIYGKDNAVRIGENSDILVTREPYVSCDPDECRFYALSQGTTIRGKHSNGTIHDRSQYRSLISWPLSSPPTVYNSRVECIGWSSTSCHDGKSRMSICISGPNNNASAVVWYNRRPVAEINTWARNILRTQESECVCHNGVCPVVFTDGSATGPAETRIYYFKEGKILKWESLTGTAKHIEECSCYGERTGITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPIQGQTIVLNTDWSGYSGSFIDYWAEGDCYRACFYVELIRGRPKEDKVWWTSNSIVSMCSSTEFLGQWNWPDGAKIEYFL

SEQ ID NO: 23713 - protein, 470 aa, Artificial Sequence
  neuraminidase__InfluenzaA__AGQ81969
MNPNQKILCTSATAIVIGIIAVLIGIANLGLNIGLHLKPSCNCSHSQPEETNASQTIINNYYNETNITQISNTNIQMEERASRGFNNLTKGLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPAETRIYYFKEGKILKWESLTGTAKHIEECSCYGERTGITCTCRDNWQGSNRPVIQIDPVAMTHTSQYICSPVLTDNPRPNDPNVGKCNDPYPGNNNNGVKGFSYLDGVNTWLGRTISTASRSGYEMLKVPNALTDDRSKPIQGQIIVLNTDWSGYSGSFMDYWAEGDCYRACFYVELIRGRPKEDKVWWTSNSIVSMCSSTEFLGQWNWPDGAKIEYFL

SEQ ID NO: 23714 - protein, 470 aa, Artificial Sequence
  neuraminidase__InfluenzaA__AGQ81970
MNPNQKILCTSATAIVIGTIAVLIGIANLGLNIGLHLKPSCNCSHSQPEETNASQTIINNYYNETNITQISNTNIQMEERASRGFNNLTKGLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAVVWYNKRPVAEINTWARNILRTQESECVCHNGVCPVVFTDGSATGPADTRIYYFKEGKILKWEPLTGTAKHIEECSCYGERTGITCTCRDNWQGSNRPVIQIDPVAMTHTSQYICSPVLTDNPRPNDPNVGKCNDPYPGNSNNGVKGFSYLDGVNTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWNWPDGAKIEYFL

SEQ ID NO: 23715 - protein, 470 aa, Artificial Sequence
  neuraminidase__InfluenzaA__AGQ81971
MNPNQKILCTSATAIIIGAIAVLIGIANLGLNIGLHLKPSCNCSHSQPETTNTSQTIINNYYNETNITQISNTNIQMEERTSRGFNNLTKGLCTINSWHIYGKDNAVRIGESSDVLVTREPYVSCDPDECRFYALSQGTTIRGKHSNGTIHDRSQYRALISWPLSSPPTVYSSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWNWPDGAKIEYFL

SEQ ID NO: 23716 - protein, 470 aa, Artificial Sequence
  neuraminidase__InfluenzaA__AGQ81972
MNPNQKILCTSATAIIIGAIAVLIGIANLGLNIGLHLKPSCNCSHSQPETTNTSQTIINNYYNETNITQISNTNIQMEERASRGFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWNWPDGAKIEYFL

SEQ ID NO: 23717 - protein, 470 aa, Artificial Sequence
  neuraminidase__InfluenzaA__AGQ81973
MNPNQKILCTSATAIIIGAIAVLIGIANLGLNIGLHLKPSCNCSHSQPETTNTSQTIINNYYNETNITQISNTNIQMEERTSRGFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPNDPNIGKCNDPYPGNNNNGVKGFSYLDGANTWLGRTISTASRSGYEMLKVPNALTDDRSKPIQGQTIVLNTDWSGYSGSFMDYWAEGDCYRACFYVELIRGRPKEDKVWWTSNSIVSMCSSTEFLGQWNWPDGAKIEYFL

SEQ ID NO: 23718 - protein, 470 aa, Artificial Sequence; identical to SEQ ID NO: 23698
  neuraminidase__InfluenzaA__AGQ81974

SEQ ID NO: 23719 - protein, 465 aa, Artificial Sequence
  neuraminidase__InfluenzaA__AGQ81975
MNPNQKILCTSATAIIIGAIAVLIGIANLGLNIGLHLKPGCNCSHSQPETTNTSQTIINNYYNETNITNIQMEERTSRNFNNLTKWLCTINSWHIYGKDNAVRIGENSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPDDPNIGKCNDPYPGNNNNGVKGFSYLDGANTWLGRTISTASRSGYEMLKVPNALTDDRSKPIQGQTIVLNADWSGYSGSFMDYWADGDCYRACFYVELIRGRPKEDKVWWTSNSIVSMCSSTEFLGQWNWPDGAKIEYFL

SEQ ID NO: 23720 - protein, 465 aa, Artificial Sequence
  neuraminidase__InfluenzaA__AGQ81977
MNPNQKILCTSATAIIIGAIAVLIGIANLGLNIGLHLKPGCNCSHSQPETTNTSQTIINNYYNETNITNIQMEERTSRNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPDDPNIGKCNDPYPGNNNNGVKGFSYLDGANTWLGRTISTASRSGYEMLKVPNALTDDRSKPIQGQTIVLNADWSGYSGSFMDYWADGDCYRACFYVELIRGRPKEDKVWWTSNSIVSMCSSTEFLGQWNWPDGAKIEYFL

SEQ ID NO: 23721 - protein, 465 aa, Artificial Sequence
  neuraminidase__InfluenzaA__AGQ81979
MNPNQKILCTSATAIIIGAIAALIGIANLGLNIGLHLKPGCNCSHSQPETTNTSQTIINNYYNETNITNIQMEERTSRNFNNLTKGLCTINSWHIYGKDNAVRIGESSDVLVTREPYVSCDPDECRFYALSQGTTIRGKHSNGTIHDRSQYRALISWPLSSPPTVYNSRVECIGWSSTSCHDGKSRMSICISGPNNNASAVVWYNRRPVAEINTWARNILRTQESECVCHNGVCPVVFTDGSATGPADTRIYYFKEGKILKWESLTGTAKHIEECSCYGERTGITCTCRDNWQGSNRPVIQIDPVAMTHTSQYICSPVLTDNPRPDDPNIGKCNDPYPGNNNNGVKGFSYLDGANTWLGRTISTASRSGYEMLKVPNALTDDRSKPIQGQTIVLNADWSGYSGSFMDYWADGDCYRACFYVELIRGRPKEDKVWWTSNSIVSMCSSTEFLGQWNWPDGAKIEYFL

SEQ ID NO: 23722 - protein, 465 aa, Artificial Sequence; identical to SEQ ID NO: 23720
  neuraminidase__InfluenzaA__AGQ81980

SEQ ID NO: 23723 - protein, 449 aa, Artificial Sequence
  neuraminidase__InfluenzaA__AGQ88501
MNPNQKIVTIGSICMVIGIVSLMLQIGNMISIWVSHSIQTGNQHQTEPIRNTNFLTENAVASVALSGNSSLCPIRGWAVHSKDNSIRIGSKGDVFVIREPFISCSNLECRTFFLTQGALLNDKHSNGTVKDRSPHRTLMSCPIGEAPSPYNSRFESVAWSASACHDGISWLTIGISGPDNGAVAVLKYNGIITDTIKSWRNNILRTQESECTCVNGSCFTVMTDGPSNGQASYKIFKIEKGKVVKSVELNAPNYHYEECSCYPDAGEIICVCRDNWHGSNRPWVSFNQNLEYQIGYICSGVFGDNPRPNDGEGSCGPVSPNGAYGVKGFSFKYGNGVWIGRTKSTHSRSGFEMIWDPNGWTGTDSEFSMKQDIVAITDWSGYSGSFVQHPELTGLDCIRPCFWVELIRGRPKESTIWTSGSSISFCGVNSDTVSWSWPDGAELPFTIDK

SEQ ID NO: 23724 - protein, 466 aa, Artificial Sequence; identical to SEQ ID NO: 23602
  neuraminidase__InfluenzaA__AGR33906

SEQ ID NO: 23725 - protein, 466 aa, Artificial Sequence
  neuraminidase__InfluenzaA__AGR33908
MNPNQKITAIGSVSLIIAIICLLMQIAILTTTMTLHFRQNECSNPSNNQVMPCEPIIIERNTVHLNSTTIEREICPKVAEYKNWSKPQCQITGFAPFSKDNSIRLSAGGDIWVTREPYVSCSPDKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGEADTRILFIREGKIINISPLSGSAQHVEECSCYPRYPEVRCVCRDNWKGSNRPIIYINMVDYSIESRYVCSGLVGDTPRNDDSTSSSNCRDPNNERGAPGVKGWAFDDGNDVWMGRTIKNGSRSGYETFRVINGWTMANSKSQINRQVIVDSDNWSGYSGIFSVEGKKCINRCFYVELIRGRPQEPRVWWTSNSIIVFCGTSGTYGTGSWPDGADINFMPI

SEQ ID NO: 23726 - protein, 466 aa, Artificial Sequence
  neuraminidase__InfluenzaA__AGR33910
MNPNQKIIAIGSVSLTIAIICFLMQIAILTTTMTLHFKQNECSKPSNNQVVPCEPILIERNTVHLNSTTIEKEVCPKVAEYKNWSKPQCQITGFAPFSKDNSIRLSAGGDIWVTREPYVSCSFGKCYQFALGQGTTLKNKHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRILFIREGKIINIRPLSGSAQHVEECSCYPRYPEVRCVCRDNWKGSNRPVLYINMADYSVESSYVCSGLVGDTPRNDDSSSSSNCRDPNNERGAPGVKGWAFDDGNDVWMGRTIRNDSRSGYETFRVVNGWTTANSKSQINRQVIVDSENWSGYSGIFSVEGKNCINRCFYVELIRGRPQEPRVWWTSNSIIVFCGTSGTYGTGSWPDGANINFMPI

SEQ ID NO: 23727 - protein, 466 aa, Artificial Sequence
  neuraminidase__InfluenzaA__AGR33911
MNPNQKIIAIGSVSLTIAIICFLMQIAILTTTMTLHFKQNECSNPSNNQVVPCEPILIERNTVHLNSTTIEKEVCPKVAEYKNWSKPQCQITGFAPFSKDNSIRLSAGGDIWVTREPYVSCSLGKCYQFALGQGTTLKNNHSNGTTHDRTPHRTLLMNELGVPFHLGTKQVCIAWSSSSCYDGKAWLHICVTGDDKNATASIIYDGMLVDSIGSWSKNILRTQESECVCINGTCAVVMTDGSASGKADTRILFIREGKIINISPLSGSAQHVEECSCYPRYPEVRCVCRDNWKGSNRPVLYINMADYSIESSYVCSGLVGDTPRNDDSSSSSNCRDPNNERGAPGVKGWAFDDGNDVWMGRTIRNNSRSGYETFRVVNGWTTANSKSQINRQVIVDSENWSGYSGIFSVEGKNCINRCFYVELIRGRPQEPRVWWTSNSIIVFCGTSGTYGTGSWPDGANINFMPI

SEQ ID NO: 23728 - protein, 451 aa, Artificial Sequence; identical to SEQ ID NO: 23643
  neuraminidase__InfluenzaA__AGR33912

SEQ ID NO: 23729 - protein, 451 aa, Artificial Sequence; identical to SEQ ID NO: 23673
  neuraminidase__InfluenzaA__AGR33913

SEQ ID NO: 23730 - protein, 451 aa, Artificial Sequence; identical to SEQ ID NO: 23643
  neuraminidase__InfluenzaA__AGR33915

SEQ ID NO: 23731 - protein, 451 aa, Artificial Sequence
  neuraminidase__InfluenzaA__AGR33916
MNPNQKLFASSGVAIALSVLNLLIGLSNVGLNVSLHLKETGPKQEENLTCMTTKETELGTPSYLLLNKSLCNVEGWVVIAKDNAVRFGESEQIIITREPYVSCDPNGCKMYALHQGTTIRNKHSNGTIHDRTAFRGLISTPLGTPPTVSNSDFICVGWSSTTCHDGIGRMTICIQGNNDNATATVYYNRRLTTTIKTWARNILRTQESECVCHNGTCAVVMTDGSASSQAHTKVMYFHKGLVVKEEALKGSAKHIEECSCYGHNQKVTCVCRDNWQGANRPIIEIDMNTLEHTSRYVCTGILTDTSRPGDKPTGDCSNPITGSPGAPGVKGFGFLNGDNTWLGRTISPRSRSGFEMLKIPNAGIDPNSRIAERQEIVDNSNWSGYSGSFIDYWNDNSECYNPCFYVELIRGRPEEAKYVWWTSNSLIALCGSPFPVGSGSFPDGAQIQYFS

SEQ ID NO: 23732 - protein, 451 aa, Artificial Sequence; identical to SEQ ID NO: 23673
  neuraminidase__InfluenzaA__AGR33917

SEQ ID NO: 23733 - protein, 451 aa, Artificial Sequence; identical to SEQ ID NO: 23643
  neuraminidase__InfluenzaA__AGR33918

SEQ ID NO: 23734 - protein, 465 aa, Artificial Sequence; identical to SEQ ID NO: 23720
  neuraminidase__InfluenzaA__AGR33919

SEQ ID NO: 23735 - protein, 470 aa, Artificial Sequence
  neuraminidase__InfluenzaA__AGR45094
MNPNQKIITIGSISMAIGIISLILQIGNIISIWASHSIQTGSQNHTGICNQRIITYENSTWVNQTYVNINNTNVVAGKDKTSVTLAGNSSLCPIRGWAIYTKDNSIRIGSKGDVFVIREPFISCSHLECRTFFLTQGALLNDKHSNGTVKDRSPYRALMSCPLGEAPSPYNSRFESVAWSASACHDGMGWLTIGISGPDNGAVAVLKYNGIITETIKSWKKRILRTQESECVCVNGSCFTIMTDGPSNGPASYRIFKIEKGKITKSIELDAPNYHYEECSCYPDTGTVMCVCRDNWHGSNRPWVSFNQNLDYQIGYICSGVFGDNPRPKDGEGSCNPVTVDGADGVKGFSYRYGNGVWIGRTKSNSSRKGFEMIWDPNGWTDTDSDFSVKQDVVPMTDWSGYSGSFVQHPELTGLDCMRPCFWVELIRGRPRENTTIWTSGSSISFCGVNSDTANWSWPDDAELPLTIDK

SEQ ID NO: 23736 - protein, 470 aa, Artificial Sequence; identical to SEQ ID NO: 18930
  neuraminidase__InfluenzaA__AGR49780

SEQ ID NO: 23737 - protein, 469 aa, Artificial Sequence
  neuraminidase__InfluenzaA__AGR49804
MNPNQKIITIGSVCMTIGMANLILQIGNIISIWISHSIQLGNQNQIETCNQSVITYENNTWVNQTYVNISNTNFAAGQSVVSVKLTGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23738 - protein, 470 aa, Artificial Sequence; identical to SEQ ID NO: 18930
  neuraminidase__InfluenzaA__AGR49820

SEQ ID NO: 23739 - protein, 469 aa, Artificial Sequence; identical to SEQ ID NO: 16090
  neuraminidase__InfluenzaA__AGR49832

SEQ ID NO: 23740 - protein, 470 aa, Artificial Sequence; identical to SEQ ID NO: 18930
  neuraminidase__InfluenzaA__AGR49844

SEQ ID NO: 23741 - protein, 470 aa, Artificial Sequence; identical to SEQ ID NO: 18930
  neuraminidase__InfluenzaA__AGR49856

SEQ ID NO: 23742 - protein, 470 aa, Artificial Sequence; identical to SEQ ID NO: 18930
  neuraminidase__InfluenzaA__AGR49868

SEQ ID NO: 23743 - protein, 469 aa, Artificial Sequence; identical to SEQ ID NO: 16728
  neuraminidase__InfluenzaA__AGR49880

SEQ ID NO: 23744 - protein, 469 aa, Artificial Sequence; identical to SEQ ID NO: 18484
  neuraminidase__InfluenzaA__AGR49891

SEQ ID NO: 23745 - protein, 469 aa, Artificial Sequence
  neuraminidase__InfluenzaA__AGR49903
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 23746 - protein, 469 aa, Artificial Sequence; identical to SEQ ID NO: 16090
  neuraminidase__InfluenzaA__AGR49915

SEQ ID NO: 23747 - protein, 469 aa, Artificial Sequence; identical to SEQ ID NO: 16090
  neuraminidase__InfluenzaA__AGR49927

SEQ ID NO: 23748 - protein, 469 aa, Artificial Sequence
  neuraminidase__InfluenzaA__AGR49939
MNPNKKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 23749 - protein, 469 aa, Artificial Sequence; identical to SEQ ID NO: 16685
  neuraminidase__InfluenzaA__AGR49951

SEQ ID NO: 23750 - protein, 469 aa, Artificial Sequence
  neuraminidase__InfluenzaA__AGR49963
MNPNKKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSGHCLDPNNEEGGHGVKGWAFDDGNDVWMGRTISKKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 23751 - protein, 469 aa, Artificial Sequence; identical to SEQ ID NO: 16728
  neuraminidase__InfluenzaA__AGR49975

SEQ ID NO: 23752 - protein, 470 aa, Artificial Sequence; identical to SEQ ID NO: 18930
  neuraminidase__InfluenzaA__AGR49986

SEQ ID NO: 23753 - protein, 470 aa, Artificial Sequence; identical to SEQ ID NO: 18930
  neuraminidase__InfluenzaA__AGR49998

SEQ ID NO: 23754 - protein, 469 aa, Artificial Sequence; identical to SEQ ID NO: 16728
  neuraminidase__InfluenzaA__AGR50010

SEQ ID NO: 23755 - protein, 469 aa, Artificial Sequence; identical to SEQ ID NO: 16728
  neuraminidase__InfluenzaA__AGR50021

SEQ ID NO: 23756 - protein, 469 aa, Artificial Sequence; identical to SEQ ID NO: 16738
  neuraminidase__InfluenzaA__AGR50032

SEQ ID NO: 23757 - protein, 469 aa, Artificial Sequence
  neuraminidase__InfluenzaA__AGR50043
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKDILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23758 - protein, 469 aa, Artificial Sequence; identical to SEQ ID NO: 16728
  neuraminidase__InfluenzaA__AGR50055

SEQ ID NO: 23759 - protein, 469 aa, Artificial Sequence
  neuraminidase__InfluenzaA__AGR50066
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFKIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23760 - protein, 469 aa, Artificial Sequence; identical to SEQ ID NO: 16728
  neuraminidase__InfluenzaA__AGR50077

SEQ ID NO: 23761 - protein, 469 aa, Artificial Sequence; identical to SEQ ID NO: 16728
  neuraminidase__InfluenzaA__AGR50088

SEQ ID NO: 23762 - protein, 469 aa, Artificial Sequence; identical to SEQ ID NO: 16728
  neuraminidase__InfluenzaA__AGR50099

SEQ ID NO: 23763 - protein, 469 aa, Artificial Sequence; identical to SEQ ID NO: 16728
  neuraminidase__InfluenzaA__AGR50110

SEQ ID NO: 23764 - protein, 469 aa, Artificial Sequence
  neuraminidase__InfluenzaA__AGR50121
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVPSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23765 - protein, 469 aa, Artificial Sequence
  neuraminidase__InfluenzaA__AGR50132
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACANGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23766 - protein, 469 aa, Artificial Sequence; identical to SEQ ID NO: 16728
  neuraminidase__InfluenzaA__AGR50143

SEQ ID NO: 23767 - protein, 469 aa, Artificial Sequence; identical to SEQ ID NO: 16728
  neuraminidase__InfluenzaA__AGR50154

SEQ ID NO: 23768 - protein, 470 aa, Artificial Sequence; identical to SEQ ID NO: 18930
  neuraminidase__InfluenzaA__AGR50165

SEQ ID NO: 23769 - protein, 469 aa, Artificial Sequence; identical to SEQ ID NO: 16728
  neuraminidase__InfluenzaA__AGR50177

SEQ ID NO: 23770 - protein, 469 aa, Artificial Sequence; identical to SEQ ID NO: 16728
  neuraminidase__InfluenzaA__AGR50188

SEQ ID NO: 23771 - protein, 469 aa, Artificial Sequence; identical to SEQ ID NO: 16728
  neuraminidase__InfluenzaA__AGR50199

SEQ ID NO: 23772 - protein, 469 aa, Artificial Sequence; identical to SEQ ID NO: 16728
  neuraminidase__InfluenzaA__AGR50210

SEQ ID NO: 23773 - protein, 469 aa, Artificial Sequence; identical to SEQ ID NO: 16728
  neuraminidase__InfluenzaA__AGR50221

SEQ ID NO: 23774 - protein, 469 aa, Artificial Sequence
  neuraminidase__InfluenzaA__AGR50232
MNPNQKIITIGSVCMTIGMANLILQIGNIISIWISHSIQLGNQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPNNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23775 - protein, 469 aa, Artificial Sequence; identical to SEQ ID NO: 16728
  neuraminidase__InfluenzaA__AGR50243

SEQ ID NO: 23776 - protein, 469 aa, Artificial Sequence; identical to SEQ ID NO: 16728
  neuraminidase__InfluenzaA__AGR50254

SEQ ID NO: 23777 - protein, 469 aa, Artificial Sequence; identical to SEQ ID NO: 16728
  neuraminidase__InfluenzaA__AGR50265

SEQ ID NO: 23778 - protein, 469 aa, Artificial Sequence
  neuraminidase__InfluenzaA__AGR50276
MNPNQKIITIGSVCMTIGMANLILQIGNIISIWISHSIQLGNQNQIETCNQSVITYENNTWVNQTYVNISNTNFAAEQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23779 - protein, 469 aa, Artificial Sequence; identical to SEQ ID NO: 16728
  neuraminidase__InfluenzaA__AGR50287

SEQ ID NO: 23780 - protein, 469 aa, Artificial Sequence
  neuraminidase__InfluenzaA__AGR50298
MNPNQKIITIGSVCMTIGMANLILQIGNTISIWISHSIQPGNQNQIETCNQSVITYENNTWVNQTYVNISNTNFAAGQSVVSVKLAGNSSLCPVSGWAIYSKDNSIRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23781 - protein, 469 aa, Artificial Sequence; identical to SEQ ID NO: 16728
  neuraminidase__InfluenzaA__AGR50309

SEQ ID NO: 23782 - protein, 469 aa, Artificial Sequence; identical to SEQ ID NO: 16728
  neuraminidase__InfluenzaA__AGR50320

SEQ ID NO: 23783 - protein, 469 aa, Artificial Sequence; identical to SEQ ID NO: 16728
  neuraminidase__InfluenzaA__AGR50331

SEQ ID NO: 23784 - protein, 469 aa, Artificial Sequence
  neuraminidase__InfluenzaA__AGR50342
MNPNQKIITIGSVCMTIGMANLILQIGNIISIWISHSIQLGNQNQIETCNQSVITYENNTWVNQTYVNISNTNFAAGQSVISVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDNGAVAVLKYNGIITDTIKSWRNNILRTQESECACVNGSCFTVMTDGPSNGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRNGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23785 - protein, 469 aa, Artificial Sequence; identical to SEQ ID NO: 16728
  neuraminidase__InfluenzaA__AGR50353

SEQ ID NO: 23786 - protein, 470 aa, Artificial Sequence; identical to SEQ ID NO: 18930
  neuraminidase__InfluenzaA__AGR50364

SEQ ID NO: 23787 - protein, 469 aa, Artificial Sequence
  neuraminidase__InfluenzaA__AGR55170
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPNSKLQINRQIIVDRGNRSGYSGIFSVEGKSCINRCFYVELIRGRKEETEVLWTSNSIVVFCGTSGTYGTGSWPDGADINLMPI

SEQ ID NO: 23788 - protein, 469 aa, Artificial Sequence; identical to SEQ ID NO: 14145
  neuraminidase__InfluenzaA__AGR55180

SEQ ID NO: 23789 - protein, 469 aa, Artificial Sequence; identical to SEQ ID NO: 14145
  neuraminidase__InfluenzaA__AGR55181

SEQ ID NO: 23790 - protein, 469 aa, Artificial Sequence; identical to SEQ ID NO: 14145
  neuraminidase__InfluenzaA__AGR55183

SEQ ID NO: 23791 - protein, 469 aa, Artificial Sequence
  neuraminidase__InfluenzaA__AGR55184
MNPNQKIITIGSVSLTIATICFLMQIAILVTTVTLHFKQHECNSPPKNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSGTYGTGSWPDGADINLMPI

SEQ ID NO: 23792 - protein, 469 aa, Artificial Sequence
  neuraminidase__InfluenzaA__AGR55185
MNPNQKIITIGSVSLTIATICFLMQIAILVTTVTLHFKQHECNSPPKNQVMLCEPTIIERNITEIVYLTNTTIEKEICPKLAEYRNWSKPQCNITGFAPFSKDNSIRLSAGGDIWVTREPYVSCDPDKCYQFALGQGTTLNNGHSNDTVHDRTPYRTLLMNELGVPFHLGTRQVCIAWSSSSCHDGKAWLHVCVTGDDKNATASFIYNGRLVDSIGSWSKKILRTQESECVCINGTCTVVMTDGSASGKADTKILFIEEGKIVHISTLSGSAQHVEECSCYPRYPGVRCVCRDNWKGSNRPIVDINVKDYSIVSSYVCSGLVGDTPRKNDSFSSSHCLDPNNEEGGHGVKGWAFDDGNDVWMGRTISEKLRSGYETFKVIEGWSKPNSKLQINRQVIVERGNRSGYSGIFSVEGKSCINRCFYVELIRGRKEETEVWWTSNSIVVFCGTSRTYGTGSWPDGADINLMPI

SEQ ID NO: 23793 - protein, 469 aa, Artificial Sequence
  neuraminidase__InfluenzaA__AGR55186
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKKILRTQESECVCINGTCTVVMTDGSASGKADTKILFIEEGKIVHTSTLSGSAQHVEECSCYPRYPGVRCVCRDNWKGSNRPIVDINIKDYSIVSSYVCSGLVGDTPRKNDSSSSSHCLEPNNEEGGHGVKGWAFDDGNDVWMGRTISEKLRSGYETFKVIEGWSNPNSKLQINRQVIVDRGNRSGYSGIFSVEGKSCINRCFYVELIRGRKQETEVLWTSNSIVVFCGTSGTYGTGSWPDGADINLMPI

SEQ ID NO: 23794 - protein, 469 aa, Artificial Sequence; identical to SEQ ID NO: 14145
  neuraminidase__InfluenzaA__AGR55187

SEQ ID NO: 23795 - protein, 469 aa, Artificial Sequence; identical to SEQ ID NO: 14714
  neuraminidase__InfluenzaA__AGR55192

SEQ ID NO: 23796 - protein, 469 aa, Artificial Sequence
  neuraminidase__InfluenzaA__AGR55195
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVHDRTPYRTLLMNELGVPFHLGTKQVCIAWSSSSCHDGKAWLHVCVTGDDKNATASFIYNGRLVDSIVSWSKEILRTQESECVCINGTCTVVMTDGSASGKADTKILFIEEGKIVHTSTLSGSAQHVEECSCYPRYPGVRCVCRDHWKGSNRPIVDINIKDYSIVSSYVCSGLVGDTPRKNDSSSSSHCLDPNNEEGGHGVKGWAFDDGNDVWMGRTISEKLRLGYETFKVIEGWSNPNSKLQINRQVIVDRGNRSGYSGIFSVEGKSCINRCFYVELIRGRKEETEVLWTSNSIVVFCGTSGTYGTGSWPDGADINLMPI

SEQ ID NO: 23797 - protein, 469 aa, Artificial Sequence
  neuraminidase__InfluenzaA__AGR55204
MNPNQKIITIGSVSLTISTICFFMQIAILITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNDTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGEADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSRTYGTGSWPDGADINLMPI

SEQ ID NO: 23798 - protein, 469 aa, Artificial Sequence
  neuraminidase__InfluenzaA__AGR55218
MNPNQKIITIGSVSLTISTICFFMQIAILITTVTLHFKQYEFNSPPNNQVVLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSIVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTISEKSRLGYETFKVIEGWSNPKSKLQINRQVIVDRGNRSGYSGIFSVEGKSCINRCFYVELIRGRKEETEVLWTSNSIVVFCGTSGTYGTGSWPDGADINLMPI

SEQ ID NO: 23799 - protein, 469 aa, Artificial Sequence; identical to SEQ ID NO: 23389
  neuraminidase__InfluenzaA__AGT18726

SEQ ID NO: 23800 - protein, 469 aa, Artificial Sequence
  neuraminidase__InfluenzaA__AGT18727
MNPNQKIITIGSVCMTIGMANLILQIGNIISIWISHSIQLGSQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWSGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23801 - protein, 469 aa, Artificial Sequence; identical to SEQ ID NO: 23389
  neuraminidase__InfluenzaA__AGT18728

SEQ ID NO: 23802 - protein, 469 aa, Artificial Sequence
  neuraminidase__InfluenzaA__AGT18729
MNPNQKIITIGQVCMTIGMANLILQIGNIISIWISHSIQLGSQNQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23803 - protein, 469 aa, Artificial Sequence
  neuraminidase__InfluenzaA__AGT18730
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEINAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSISFCGVNSDTVGWSWPDGAELPFTIDK

SEQ ID NO: 23804 - protein, 469 aa, Artificial Sequence; identical to SEQ ID NO: 23389
  neuraminidase__InfluenzaA__AGT18731

SEQ ID NO: 23805 - protein, 469 aa, Artificial Sequence
  neuraminidase__InfluenzaA__AGT18732
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSEITCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTRGSSISFCGVNSDTVGWSWPDGAELPFTIDK

SEQ ID NO: 23806 - protein, 469 aa, Artificial Sequence
  neuraminidase__InfluenzaA__AGT18733
MNPNQKIITIGSVCMTIGMANLILQIGNIISIWISHSIQLGNQSQIETCNQSVITYENNTWVNQTYVNISNTNFAAGQSVVSVKLAGNSSLCPVSGWAIYSKDNSVRIGSKGDVFVIREPFISCSPLECRTFFLTQGALLNDKHSNGTIKDRSPYRTLMSCPIGEVPSPYNSRFESVAWSASACHDGINWLTIGISGPDSGAVAVLKYNGIITDTIKSWRNNILRTQESECACVNGSCFTIMTDGPSDGQASYKIFRIEKGKIVKSVEMNAPNYHYEECSCYPDSSESTCVCRDNWHGSNRPWVSFNQNLEYQIGYICSGIFGDNPRPNDKTGSCGPVSSNGANGVKGFSFKYGNGVWIGRTKSISSRKGFEMIWDPNGWTGTDNNFSIKQDIVGINEWSGYSGSFVQHPELTGLDCIRPCFWVELIRGRPKENTIWTSGSSRSFCGVNSDTVGWSWPDGAELPFTIDK

SEQ ID NO: 23807 - protein, 469 aa, Artificial Sequence
  neuraminidase__InfluenzaA__AGT18762
MNPNQKIITIGSVSLTISTICFFMQIAILITTVTLHFKQYEFNSPPNNQVTLCEPIIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI

SEQ ID NO: 23808 - protein, 469 aa, Artificial Sequence
  neuraminidase__InfluenzaA__AGT18764
MNPNQMIITIGSVSLTSSTICFFMQTASFITTVTLHIKQHEFHSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGKLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDRSSNSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23809 - protein, 469 aa, Artificial Sequence
  neuraminidase__InfluenzaA__AGT18765
MNPNQKIITIGSVSLTISTICFFMQIAILITTVTLHFKQHEFHSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDRSSNSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23810 - protein, 469 aa, Artificial Sequence
  neuraminidase__InfluenzaA__AGT18766
MNPNQKIITIGSVSLTISTICLFMQIAILITTVTLHFKQHEFHSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDRSSNSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLKPI

SEQ ID NO: 23811 - protein, 469 aa, Artificial Sequence
  neuraminidase__InfluenzaA__AGT18767
MNPNQKIITIGSVSLTISTICFFMQTASLITTVTLHFKQHEFHSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDRSSNSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23812 - protein, 469 aa, Artificial Sequence
  neuraminidase__InfluenzaA__AGT18768
MNPNQKIITIGSVSLTISTICFFMQTASFITTVTLHFKQYEFNSPPNNQVMLCEPTIIERNITEIVYLTNTTIEKEICPKLAEYRNWSKPQCDITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINMKDHSIVSSYVCSGLVGDTPRKNDRSSNSHCLDPNNEEGGHGVKGWAFDDGNDVWMGRTINETSRLGYETFKVIEGWSNPKSKLQINRQVIVDRGNRSGYSGIFSVEGKSCINRCFYVELIRGRKEETEVLWTSNSIVVFCGTSGTYGTGSWPDGADLNLMPI

SEQ ID NO: 23813 - protein, 469 aa, Artificial Sequence; identical to SEQ ID NO: 22146
  neuraminidase__InfluenzaA__AGT18769

SEQ ID NO: 23814 - protein, 469 aa, Artificial Sequence
  neuraminidase__InfluenzaA__AGT18770
MNPNQKIITIGSVSLTISTICFFMQIAILITTVTLHFKQYEFNSPPNNKVMLCEPTIIERNITEIVYLTNTTIEKEICPKPAEYRNWSKPQCGITGFAPFSKDNSIRLSAGGDIWVTREPYVSCDPDKCYQFALGQGTTLNNVHSNNTVRDRTPYRTLLMNELGVPFHLGTKQVCIAWSSSSCHDGKAWLHVCITGDDKNATASFIYNGRLVDSVVSWSKEILRTQESECVCINGTCTVVMTDGSASGKADTKILFIEEGKIVHTSTLSGSAQHVEECSCYPRYPGVRCVCRDNWKGSNRPIVDINIKDHSIVSSYVCSGLVGDTPRKNDSSSSSHCLDPNNEEGGHGVKGWAFDDGNDVWMGRTINETSRLGYETFKVIEGWSNPKSKLQINRQVIVDRGDRSGYSGIFSVEGKSCINRCFYVELIRGRKEETEVLWTSNSIVVFCGTSGTYGTGSWPDGADLNLMPI
